United States Patent 11,446,398 (REGULATED BIOCIRCUIT SYSTEMS) - sequence listing, part 64

SEQ ID NO: 160944 - DNA, 3389 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000504572
  CDS Start-End: 284-2620
gataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaaggatccctctggctggtgtgtgaagaattaactgtagatgggcaagtgtggaaggaaggagagcagtcaggaagctgccataaccatctacatgagagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaa

SEQ ID NO: 160945 - DNA, 585 bp, Homo sapiens
  Payload ID: 11442
  Gene Symbol: NR3C1
  Gene Name: nuclear receptor subfamily 3, group C, member 1 (glucocorticoid receptor)
  ENST ID: ENST00000510170
  CDS Start-End: 150-585
ggcgcctggcttgaggagggcgtgcggggcgcgtgagggtgcacacgcggggggctgacagcccgcaacttggagactgcggccggggccggcgttatctgttagaagtgggcgtgtcggagagagaactcaacagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg

SEQ ID NO: 160946 - DNA, 547 bp, Homo sapiens
  Payload ID: 11442
  Gene Symbol: NR3C1
  Gene Name: nuclear receptor subfamily 3, group C, member 1 (glucocorticoid receptor)
  ENST ID: ENST00000508760
  CDS Start-End: 112-547
cgtgcaggcgccgtcggggccggggtggcggggcccgcgcggagggcgtgggggcagggaccgcgggcgcccctgcagttgccaagcgtcaccaacagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg

SEQ ID NO: 160947 - DNA, 585 bp, Homo sapiens
  Payload ID: 11442
  Gene Symbol: NR3C1
  Gene Name: nuclear receptor subfamily 3, group C, member 1 (glucocorticoid receptor)
  ENST ID: ENST00000502500
  CDS Start-End: 154-585
gtactcaaaggtttggatgtgtgactagctggtaggagggaaatttggaagtaattagggattgagaattctagcatagtatttatcaaatgttatatgtattggttctcagaaaagcaaacagccgtgattgaaaagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatcc

SEQ ID NO: 160948 - DNA, 623 bp, Homo sapiens
  Payload ID: 11442
  Gene Symbol: NR3C1
  Gene Name: nuclear receptor subfamily 3, group C, member 1 (glucocorticoid receptor)
  ENST ID: ENST00000514699
  CDS Start-End: 188-623
ggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg

SEQ ID NO: 160949 - DNA, 2594 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000503201
  CDS Start-End: 183-2516
gcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgta

SEQ ID NO: 160950 - DNA, 5712 bp, Homo sapiens
  Payload ID: 11443
  Gene Symbol: NR3C2
  Gene Name: nuclear receptor subfamily 3, group C, member 2
  ENST ID: ENST00000344721
  CDS Start-End: 176-3130
attgctctacccaccgtcagcagggcgactgccactgccgggattatcatcctctccatcctcaccgccgatcagccaatattggacttgctggtggcggcggcagcagcggcggcgggagtctagccgttccccttcccccgccccagcctccccaccatgtcctagaaaagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttactttaatcacc

SEQ ID NO: 160951 - DNA, 3150 bp, Homo sapiens
  Payload ID: 11443
  Gene Symbol: NR3C2
  Gene Name: nuclear receptor subfamily 3, group C, member 2
  ENST ID: ENST00000342437
  CDS Start-End: 215-2335
cgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaa

SEQ ID NO: 160952 - DNA, 5893 bp, Homo sapiens
  Payload ID: 11443
  Gene Symbol: NR3C2
  Gene Name: nuclear receptor subfamily 3, group C, member 2
  ENST ID: ENST00000358102
  CDS Start-End: 364-3318
aaaagggccagccctccagctggcccactccccctccgggctttcgcccgccctctctccctcccttttttgcccgccctggccctgcccctgcccctgccccctcctctcagcccctccgcgcccggggtgtcattgggcccgggagacgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttacttt

SEQ ID NO: 160953 - DNA, 2967 bp, Homo sapiens
  Payload ID: 11443
  Gene Symbol: NR3C2
  Gene Name: nuclear receptor subfamily 3, group C, member 2
  Uniprot ID: P08235
  ENST ID: ENST00000511528
  CDS Start-End: 1-2967
atggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaaggtaaatgttcatggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtga

SEQ ID NO: 160954 - DNA, 3822 bp, Homo sapiens
  Payload ID: 11443
  Gene Symbol: NR3C2
  Gene Name: nuclear receptor subfamily 3, group C, member 2
  Uniprot ID: P08235
  ENST ID: ENST00000512865
  CDS Start-End: 68-2671
ggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggg

SEQ ID NO: 160955 - DNA, 5909 bp, Homo sapiens
  Payload ID: 11443
  Gene Symbol: NR3C2
  Gene Name: nuclear receptor subfamily 3, group C, member 2
  ENST ID: ENST00000625323
  CDS Start-End: 364-3330
aaaagggccagccctccagctggcccactccccctccgggctttcgcccgccctctctccctcccttttttgcccgccctggccctgcccctgcccctgccccctcctctcagcccctccgcgcccggggtgtcattgggcccgggagacgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaaggtaaatgttcatggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttactttaatc

SEQ ID NO: 160956 - DNA, 2678 bp, Homo sapiens
  Payload ID: 11444
  Gene Symbol: NR4A1
  Gene Name: nuclear receptor subfamily 4, group A, member 1
  Uniprot ID: P22736
  ENST ID: ENST00000243050
  CDS Start-End: 320-2116
gtcacggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactg

SEQ ID NO: 160957 - DNA, 2589 bp, Homo sapiens
  Payload ID: 11444
  Gene Symbol: NR4A1
  Gene Name: nuclear receptor subfamily 4, group A, member 1
  Uniprot ID: P22736
  ENST ID: ENST00000360284
  CDS Start-End: 192-2027
ttcctggtgtaagctttggtatggatggtggccgtctccctacagactgggagctgttagagggcagggatcctagctgacacatctatgtcctcgccttggttggaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactg

SEQ ID NO: 160958 - DNA, 2639 bp, Homo sapiens
  Payload ID: 11444
  Gene Symbol: NR4A1
  Gene Name: nuclear receptor subfamily 4, group A, member 1
  Uniprot ID: P22736
  ENST ID: ENST00000394824
  CDS Start-End: 280-2076
agtcccagtggcggaggctacgaaacttgggggagtgcacagaagaacttcgggagcgcacgcgggaccagggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactga

SEQ ID NO: 160959 - DNA, 2528 bp, Homo sapiens
  Payload ID: 11444
  Gene Symbol: NR4A1
  Gene Name: nuclear receptor subfamily 4, group A, member 1
  Uniprot ID: P22736
  ENST ID: ENST00000394825
  CDS Start-End: 170-1966
gtcacggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactg

SEQ ID NO: 160960 - DNA, 3511 bp, Homo sapiens
  Payload ID: 11444
  Gene Symbol: NR4A1
  Gene Name: nuclear receptor subfamily 4, group A, member 1
  ENST ID: ENST00000545748
  CDS Start-End: 996-2954
tttctccgccggctgcgggaaccggttccaggagcgcgggagctcgtctgccaggagacccagccgggagggaccgatgctgcgtgatgcaaccccttcgagggactgagtcaagaaaccaaggctgggggtctcgtggagtcaggcggagctggggattaggactcggggcttgtgtctcccaggcgtgtttttttgttgttgttttgtttttttgccgcaacatcttccttatactgggtggggtgggggcgggggtggtctgtatttccagacctcctccatggtggtctggctgtgtggagggcagggcacagttccttgacttggctcattcccccccaacgccccccctttcttttttttttgagatggagtctcgctctgttgcccaggctggagtgcagtagcgtgatctcggctcactgcaatctccgtctcccgggttcaagcgaatctcctgcctcagcctccagagtagctgggactacaggcacccaccaccacgcccggctaatttttgtatttttagtagagacagggtttcaccatattggccaggctggtctggaactcctgaccttgtgatccgcctgcctcggcctcctaaagtgctgggattacaggcgtgagccaccgcgcctggcaggctcattccctttttatgccttcgtttttgatagatgacctggggatgggagaaatgctgcagaggtggtttatttacagtgaattgttaatttggttgtggggctagtattaggggcacattgggaaaacacaggctgggcagaggttggtaggttcacaacagttatgcccactgggtgctgatggatttgggggctgtcgtcggcctggcttggggccctagtggtggggctacaaggcttgctcctagatctactccaagtgaacatttaagatcagtgacttggatggagacttaaaaaggaagtcagctgactccgtgtagtcatccagagctgtgaggaatgacaagtgcacagtataaaatcaagattctaattgaaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttgg

SEQ ID NO: 160961 - DNA, 2029 bp, Homo sapiens
  Payload ID: 11444
  Gene Symbol: NR4A1
  Gene Name: nuclear receptor subfamily 4, group A, member 1
  Uniprot ID: P22736
  ENST ID: ENST00000550082
  CDS Start-End: 89-1924
tgtaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgca

SEQ ID NO: 160962 - DNA, 1101 bp, Homo sapiens
  Payload ID: 11444
  Gene Symbol: NR4A1
  Gene Name: nuclear receptor subfamily 4, group A, member 1
  Uniprot ID: P22736
  ENST ID: ENST00000548232
  CDS Start-End: 124-1101
agtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaa

SEQ ID NO: 160963 - DNA, 574 bp, Homo sapiens
  Payload ID: 11444
  Gene Symbol: NR4A1
  Gene Name: nuclear receptor subfamily 4, group A, member 1
  ENST ID: ENST00000550763
  CDS Start-End: 130-574
agtcccagtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtcgcacagtgcagaaaaacgccaagtacatctgcctggctaacaaggactgccctgtggacaagaggcggcgaaaccgctgccagttctgccgcttccagaagtgcctggcggtgggcatggt

SEQ ID NO: 160964 - DNA, 838 bp, Homo sapiens
  Payload ID: 11444
  Gene Symbol: NR4A1
  Gene Name: nuclear receptor subfamily 4, group A, member 1
  ENST ID: ENST00000562373
  CDS Start-End: 387-838
ctacgaaacttgggggagtgcacagaagaacttcgggagcgcacgcgggaccagggaccaggctgagactcggggcgccagtccgggcaggggcagcgggagccggccggtagtctctgttggatcttacaggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccaca

SEQ ID NO: 160965 - DNA, 607 bp, Homo sapiens
  Payload ID: 11444
  Gene Symbol: NR4A1
  Gene Name: nuclear receptor subfamily 4, group A, member 1
  ENST ID: ENST00000550582
  CDS Start-End: 247-607
ctggactcagggcccagcactgccaaactggactactccaagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgca

SEQ ID NO: 160966 - DNA, 548 bp, Homo sapiens
  Payload ID: 11444
  Gene Symbol: NR4A1
  Gene Name: nuclear receptor subfamily 4, group A, member 1
  ENST ID: ENST00000548977
  CDS Start-End: 192-548
ttcctggtgtaagctttggtatggatggtggccgtctccctacagactgggagctgttagagggcagggatcctagctgacacatctatgtcctcgccttggttggaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttc

SEQ ID NO: 160967 - DNA, 521 bp, Homo sapiens
  Payload ID: 11444
  Gene Symbol: NR4A1
  Gene Name: nuclear receptor subfamily 4, group A, member 1
  ENST ID: ENST00000553200
  CDS Start-End: 286-521
ggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgggctccctgagaccaccaggaagagcccccaaccaatcttgggattctcccttcgtgcggttgtctgggacctttttccagggtcaaagcagatcgtgaggaggaagctggtttcccatgacagtgggggagcccaggccccaggcagtgctacatttggatgtggagcctctcctttccattgtgaactgaattctac

SEQ ID NO: 160968 - DNA, 1258 bp, Homo sapiens
  Payload ID: 11444
  Gene Symbol: NR4A1
  Gene Name: nuclear receptor subfamily 4, group A, member 1
  ENST ID: ENST00000546842
  CDS Start-End: 351-1258
cgggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggctt

SEQ ID NO: 160969 - DNA, 3472 bp, Homo sapiens
  Payload ID: 11445
  Gene Symbol: NR4A2
  Gene Name: nuclear receptor subfamily 4, group A, member 2
  Uniprot ID: P43354
  ENST ID: ENST00000339562
  CDS Start-End: 364-2160
acataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaacagaa

SEQ ID NO: 160970 - DNA, 449 bp, Homo sapiens
  Payload ID: 11445
  Gene Symbol: NR4A2
  Gene Name: nuclear receptor subfamily 4, group A, member 2
  ENST ID: ENST00000406048
  CDS Start-End: 1-449
cagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcg

SEQ ID NO: 160971 - DNA, 2878 bp, Homo sapiens
  Payload ID: 11445
  Gene Symbol: NR4A2
  Gene Name: nuclear receptor subfamily 4, group A, member 2
  Uniprot ID: P43354
  ENST ID: ENST00000409572
  CDS Start-End: 436-2232
ctccccggctcccttcttggtcggccgcgaccccccgaaaggtaacaggcctctttcgcccccggccaggacctgggccctgtgggctttttttttttccattttatcagtaagttccccttgtcccagcctccgctttcacttcccgcgttccctccaccccaaaaaccgccccaacatgtccagagaggggcatctacccagccgcccagccaggggcgaccactttgtgagccccggggagcgggacccgtaccaggcgcgcccagcgggggatgcggtgaccgaggggccgggagcgccgggcagggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaa

SEQ ID NO: 160972 - DNA, 1735 bp, Homo sapiens
  Payload ID: 11445
  Gene Symbol: NR4A2
  Gene Name: nuclear receptor subfamily 4, group A, member 2
  ENST ID: ENST00000409108
  CDS Start-End: 43-1704
acctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggaggaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaa

SEQ ID NO: 160973 - DNA, 574 bp, Homo sapiens
  Payload ID: 11445
  Gene Symbol: NR4A2
  Gene Name: nuclear receptor subfamily 4, group A, member 2
  ENST ID: ENST00000421709
  CDS Start-End: 255-574
agccacataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaacttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagt

SEQ ID NO: 160974 - DNA, 2642 bp, Homo sapiens
  Payload ID: 11445
  Gene Symbol: NR4A2
  Gene Name: nuclear receptor subfamily 4, group A, member 2
  Uniprot ID: P43354
  ENST ID: ENST00000426264
  CDS Start-End: 373-1980
ataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaa

SEQ ID NO: 160975 - DNA, 2450 bp, Homo sapiens
  Payload ID: 11445
  Gene Symbol: NR4A2
  Gene Name: nuclear receptor subfamily 4, group A, member 2
  ENST ID: ENST00000417972
  CDS Start-End: 320-1498
aagttgcctgaaatttctggttttgacatatgctgtccttgggtttgcgaatgtatcagagcgagaatatgaatatgtaaagagtacagttatgaaactgtggagctaccagggggttaatatccaacacaggaatatctctaagggctgtggggttcgagtctcctttctgctttttctggggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgc

SEQ ID NO: 160976 - DNA, 1010 bp, Homo sapiens
  Payload ID: 11445
  Gene Symbol: NR4A2
  Gene Name: nuclear receptor subfamily 4, group A, member 2
  ENST ID: ENST00000424077
  CDS Start-End: 237-1010
taaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctcc

SEQ ID NO: 160977 - DNA, 1571 bp, Homo sapiens
  Payload ID: 11445
  Gene Symbol: NR4A2
  Gene Name: nuclear receptor subfamily 4, group A, member 2
  ENST ID: ENST00000429376
  CDS Start-End: 68-1540
ttacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggaggaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaa

SEQ ID NO: 160978 - DNA, 2265 bp, Homo sapiens
  Payload ID: 11445
  Gene Symbol: NR4A2
  Gene Name: nuclear receptor subfamily 4, group A, member 2
  ENST ID: ENST00000417764
  CDS Start-End: 135-1313
ggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgc

SEQ ID NO: 160979 - DNA, 4982 bp, Homo sapiens
  Payload ID: 11446
  Gene Symbol: NR4A3
  Gene Name: nuclear receptor subfamily 4, group A, member 3
  Uniprot ID: Q92570
  ENST ID: ENST00000330847
  CDS Start-End: 45-1958
caggccctcatcaccttttttcaagtcaagatttcatcccatacatgcatgactcaatcagatttggaaatgtggatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatctttttaaaaaatagtatgaatgtgaatactagaaaagatttaaaaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 160980 - DNA, 2588 bp, Homo sapiens
  Payload ID: 11446
  Gene Symbol: NR4A3
  Gene Name: nuclear receptor subfamily 4, group A, member 3
  Uniprot ID: Q92570
  ENST ID: ENST00000338488
  CDS Start-End: 730-2061
ataaatgacgtgccgagagagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagagtaagttttatgatttcctgctttcaaatgaatgatcagggtctctatttatggctactagtaataagagttgattgaatgattttgtgtctggcaccatgttagacagttttcatactttttctatatttctcgcttcatttagcaattcagtgcatccattgcagcaaataatttttgccttattgaatctctaaatgccttaacaagtgaccctgacagtgctgcacctgtcatacacattgttgcaggattcctggtggttgtgccaatgaaaatctgcacagacaaactacaatttgtagatttatctcgtgatctagacaaagtgactactgttttttttcatattgtgttcaaaccatctgggtgagcctcaagttattactaagcagtttatccaattgcatcagcattgattgacctgctgcttattcagagggattagaccattggtggagagaagcgagctctggctgtgacatcagttgtcaggagaactgggatggaacgccacctctgctacttcctgcctgtgtcacctggttcctgcttttggctctctcctgcctacagtggaaatggctacaatatttaacctcaga

SEQ ID NO: 160981 - DNA, 3794 bp, Homo sapiens
  Payload ID: 11446
  Gene Symbol: NR4A3
  Gene Name: nuclear receptor subfamily 4, group A, member 3
  Uniprot ID: Q92570
  ENST ID: ENST00000395097
  CDS Start-End: 730-2610
ataaatgacgtgccgagagagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatctttttaaaaaatagtatgaatgtgaatactagaaaagatttaaaaaatagtatgagtgtgagtactaggaaggat

SEQ ID NO: 160982 - DNA, 5706 bp, Homo sapiens
  Payload ID: 11446
  Gene Symbol: NR4A3
  Gene Name: nuclear receptor subfamily 4, group A, member 3
  Uniprot ID: Q92570
  ENST ID: ENST00000618101
  CDS Start-End: 769-2682
ataaatgacgtgccgagagagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccaggccctcatcaccttttttcaagtcaagatttcatcccatacatgcatgactcaatcagatttggaaatgtggatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatctttttaaaaaatagtatgaatgtgaatactagaaaagatttaaaaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 160983 - DNA, 768 bp, Homo sapiens
  Payload ID: 11447
  Gene Symbol: NR5A1
  Gene Name: nuclear receptor subfamily 5, group A, member 1
  ENST ID: ENST00000373587
  CDS Start-End: 1-738
gtggaggaggaaggagatgtgtcaaacagaggagtggagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactggg

SEQ ID NO: 160984 - DNA, 3104 bp, Homo sapiens
  Payload ID: 11447
  Gene Symbol: NR5A1
  Gene Name: nuclear receptor subfamily 5, group A, member 1
  Uniprot ID: Q13285
  ENST ID: ENST00000373588
  CDS Start-End: 198-1583
gggaggaggaggaggacggacggacagggccagcctgctgtccggctgccgcccgccgtggtgtgagggggtttctgcgcacccacagtcgccaccgtcccacctgggctgccggagcctccccctggacccctggtgcccactgccaccctcatccggtgtgagagcgctgcttccgcttcgcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgggccactggctggctacctctaccctgcctttcctggccgtgccatcaagtctgagtacccggagccttatgccagccccccacagcctgggctgccgtacggctacccagagcccttctctggagggcccaacgtgcctgagctcatcctgcagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttcc

SEQ ID NO: 160985 - DNA, 826 bp, Homo sapiens
  Payload ID: 11447
  Gene Symbol: NR5A1
  Gene Name: nuclear receptor subfamily 5, group A, member 1
  ENST ID: ENST00000455734
  CDS Start-End: 294-826
ttggcccaggcctctaatggccagcctccttctgcagtgcctccctgcagcctgggccggccactgcctgctccacttagtgaccggtgccccctgctctgggcagggaaggtgccaggggtctcccagactcaccctcccaccatgctaccccctcttcttccctgggctgccgatgggaggagccaggcctgtgaccacaagccccatggaggtccgctggtgtcccgctgtctctggccaggcatccaccaggctgtgtgggtctgagcctagaggcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgg

SEQ ID NO: 160986 - DNA, 2975 bp, Homo sapiens
  Payload ID: 11447
  Gene Symbol: NR5A1
  Gene Name: nuclear receptor subfamily 5, group A, member 1
  ENST ID: ENST00000620110
  CDS Start-End: 188-1453
ggaggacggacggacagggccagcctgctgtccggctgccgcccgccgtggtgtgagggggtttctgcgcacccacagtcgccaccgtcccacctgggctgccggagcctccccctggacccctggtgcccactgccaccctcatccggtgtgagagcgctgcttccgcttcgcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgggccactggctggctacctctaccctgcctttcctggccgtgccatcaagtctgagtacccggagccttatgccagccccccacagcctgggctgccgtacggctacccagagcccttctctggagggcccaacgtgcctgagctcatcctgcagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttcca

SEQ ID NO: 160987 - DNA, 3115 bp, Homo sapiens
  Payload ID: 11448
  Gene Symbol: NR5A2
  Gene Name: nuclear receptor subfamily 5, group A, member 2
  Uniprot ID: O00482
  ENST ID: ENST00000236914
  CDS Start-End: 235-1722
atggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgttaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaata

SEQ ID NO: 160988 - DNA, 1793 bp, Homo sapiens
  Payload ID: 11448
  Gene Symbol: NR5A2
  Gene Name: nuclear receptor subfamily 5, group A, member 2
  ENST ID: ENST00000367357
  CDS Start-End: 1-1133
aagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaagggtctcactctgtcgcccagtctggagtgcagtggcacgatcttggctcatggcaacctccacctcctgcattcaagtgattcgcctgcctcagcctcccgagtagctgggattacaggcgtgcaccacaacacccatctaatttttgtatttttagtagagatgggattttgccatgttggccaggctggtctcaaaactcctgacctcagggtgatctgcctgcctcggcctcccaaagtgctgggattatgggcatgagccactgcgcctggccgtaattgtgcttttttttccttttttctttttttgagatggagttacactcttgttgcctgggctggggtgcaatggcacagtctcggctcactgcaacctccacctcctgggttccagcaattctcctgcctcagcctcccgagtagctgggattacaggcatgcgccaccatgcctagctaattttcgtattattagtagaaacaaggtttcaccatgtcagccaggctggtctcaaactcctgacctcagatgatccacccgccttggcctcccaaagtgctgggattacagatgtgagccaccacgctcagccaaattgtactttcagtaaagtactttactgtttacaaagaacttccatatacatttttttggtcctggtctctgtctttcattttgggagcatggatgtaactggcctttcatcaatggttcagtagtgttgttttttaaagcctacaacagaaccatctcctatgaattgactatcacctgtctaaatgccctgtttacagcatgttgtacctgcaagagcaggatatttaaagtactttataattgataattgccattatcaatatgctcacctctttaccatattccaacaggtcttaaaggacttgtattattttttaccgaa

SEQ ID NO: 160989 - DNA, 5086 bp, Homo sapiens
  Payload ID: 11448
  Gene Symbol: NR5A2
  Gene Name: nuclear receptor subfamily 5, group A, member 2
  Uniprot ID: O00482
  ENST ID: ENST00000367362
  CDS Start-End: 247-1872
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattggtgctgggcttccggaccgacacggatcccccatccccgcccgcggtcgccttgtcatgctgcccaaagtggagacggaagccctgggactggctcgatcgcatggggaacagggccagatgccggaaaacatgcaagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgttaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcgcagtctcagtcacccgtgttatcttcgtggctcaaaggacaatgcaaaatcgccgatcagagctcatacccaaagcattacagagaacagcagcatcattgccctccccagctgaaaaacaagttggctagaagatacatggagaggaatggtgtggtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccatagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaa

SEQ ID NO: 160990 - DNA, 213 bp, Homo sapiens
  Payload ID: 11448
  Gene Symbol: NR5A2
  Gene Name: nuclear receptor subfamily 5, group A, member 2
  ENST ID: ENST00000447034
  CDS Start-End: 1-213
gtctttaaagcacggacttacacctattgatcgaggaaattgccgctctggctgcttctccttcgccgccacgctcagacagaggtcgcttctgactagctgtgctgggcttccggaccgacacggatcccccatccccgcccgcggtcgccttgtcatgctgcccaaagtggagacggaagccctgggactggctcgatcgcatggggaaca

SEQ ID NO: 160991 - DNA, 1713 bp, Homo sapiens
  Payload ID: 11448
  Gene Symbol: NR5A2
  Gene Name: nuclear receptor subfamily 5, group A, member 2
  ENST ID: ENST00000474307
  CDS Start-End: 192-533
cagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgataacacagaaaatacaggcacaagaaagatgagagagcagcacacaaccatttcgcatctttttcgtcgggcagaaccgccgcggtgcgcaggcaaggagtccttcccggcagctccgcgcagctccggttccgcgtccggggccgcagctagagcgcgctcgggccggagacgcggactgcgcgcgcacgggggacgcgcgctcgggggctcgcgcccgcgcgggcggtcttgggctcctgctgcgcgcagccccagctggccgctgccaaaatagagttgagctgggtcgggagaccacgcacgccgatccctcacagtctcccccacaccccatgggtgaattaaagagggtaaggtaggggaaagagacgctgttgcacttttctctgcaaccctggaagaactgtgtttccagctaccgcacgcgcaactcacatcgcaagggaccgaggcggtacactctgagcgtaaacagagaacacctgcagctctggaatcggtcccaccgcagagggctgggaaccggaggactgtcggtccagcccataaggggctgctggggactaaacctcaagaaaagtaccgaagaaggctctcccctggcctcagcgagactaccccaacatcctaaacctgtgcaggcacttccgggcgccggattccgggataacaaaattccagtcaatttgccgtgtctcaatttaaaatggtgaattactcctatgatgaagatctggaagagctttgtcccgtgtgtggagataaagtgtctgggtaccattatgggctcctcacctgtgaaagctgcaaggtttgctcacacattgctacctgaaaaatataatgtccaacaccaaaataaaccagtggattacttcttttaagctaaatttaggctccttttttaaagactcaactaaaaatgagggagaaagagagagtcttagggagatgattcttagaagtgtgtgtctgatttagttcaaaaggcaaagaaatttatgctgtttagaaaactttgccagtctcatggttctaaaatactttattgtagtaaagtgatatagctgtagaaagacttccatttctaacagtcctaaatattgattttgcttgacttatatatatttaaagcatcgttgttcttgaaagggaatatgacaaactatttcccaaatacattttaacttcagagtatttctgtgctataagtctaaacattctttatccacagacataaaagcctaaattcccaactgtgtgatttcatcttgatttattccaaaataattttaaggattttttgaaatttatatcataaagaccaagaaatcagattttagtttttaatataataatttttataaatatatgacctatttaagtgcatggattttaatatgtaaaatatgctatattgttaccaaaaatataaattatactttaagaattta

SEQ ID NO: 160992 - DNA, 4775 bp, Homo sapiens
  Payload ID: 11448
  Gene Symbol: NR5A2
  Gene Name: nuclear receptor subfamily 5, group A, member 2
  Uniprot ID: O00482
  ENST ID: ENST00000544748
  CDS Start-End: 156-1565
atagtttgtcatctttttagctgcgaagacgccttcgtgggtctgcgtccggagcaaggcggttacccgatcccggcagtgagccgcgccgcgcgtcgtggcggcctgatttctgtttaactttaatagggcgatctcgagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgttaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcgcagtctcagtcacccgtgttatcttcgtggctcaaaggacaatgcaaaatcgccgatcagagctcatacccaaagcattacagagaacagcagcatcattgccctccccagctgaaaaacaagttggctagaagatacatggagaggaatggtgtggtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccatagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataattttt

SEQ ID NO: 160993 - DNA, 1846 bp, Homo sapiens
  Payload ID: 11449
  Gene Symbol: NR6A1
  Gene Name: nuclear receptor subfamily 6, group A, member 1
  Uniprot ID: Q15406
  ENST ID: ENST00000344523
  CDS Start-End: 169-1608
ggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactatttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaa

SEQ ID NO: 160994 - DNA, 1890 bp, Homo sapiens
  Payload ID: 11449
  Gene Symbol: NR6A1
  Gene Name: nuclear receptor subfamily 6, group A, member 1
  Uniprot ID: Q15406
  ENST ID: ENST00000373584
  CDS Start-End: 179-1609
gcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatg

SEQ ID NO: 160995 - DNA, 1898 bp, Homo sapiens
  Payload ID: 11449
  Gene Symbol: NR6A1
  Gene Name: nuclear receptor subfamily 6, group A, member 1
  Uniprot ID: Q15406
  ENST ID: ENST00000416460
  CDS Start-End: 192-1619
gtgctgagggggcgcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaaga

SEQ ID NO: 160996 - DNA, 7031 bp, Homo sapiens
  Payload ID: 11449
  Gene Symbol: NR6A1
  Gene Name: nuclear receptor subfamily 6, group A, member 1
  Uniprot ID: Q15406
  ENST ID: ENST00000487099
  CDS Start-End: 159-1601
gcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactatttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccttttttagccacagaattgccagataaaacggcacactgtaagggggcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcaccttcttctgcctatttagtcaaaggctgtttgctgtctcctcaactcaacctagtaaagctacccaggagggcaccacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagaacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggtttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttttttgaggcggagtctcgctctgtcgctcaggctggagtgcagtggtgcgatcttggctcactgcaagctccgcctcccgggttcatgccattctcctgcctcagcctcctgagtagctgggactacaggcgcccgccaccacacccggctaactttttttgtatttttagtagaaacattgtttcaccacgttagccaggatggtctccatctcctgacctcgtgatccgcctgcctcggcctcccaaagtgctgggattacaggcgtgagccactgcacccagccgagtgagaatttttatgccataaaaatacgactctgaaagctacatggaaaaggagaatcccacctccttgcactacattgaaacatgcaagcctttccctccctctcctttttgatgttttcttgtcccaagacaaaagtttggcatcttggaacttattcatgctctctggctgcctttgtagacttttggagtcctttgcaaggtttggtggtctcgtcgttaatctggagaaattccccagaatctgtctcaaagcgctcaacctggctcagaggacacccagcccctatgccccactcacaagagaggtgggcaagcccccagggataggaggaagtaagcaggatcctccctgtcctgtttcccagaaccagagcaaggaatggggaatcctaagggtttctgtggcatcactgaatgtcacccactccacatcaacctgcctctcacctgccaccctttttcagggaggtgagtacctgccatggtcactgttaccagatccttaaaatcctgggctctgagctaggtgcattgctctgttacccatttcctacatttgtttgtttgttcttgatttcctgggggaatgggactgatggagacagacaaacccactgtgggcagcatctaagccatgtccaaggttggtcgaattaagggaaccctggcctctcagcaggacagaaagctgagctgtggttccaggccctcctctctgggcccctggtgtgtatcttttttccttgttgcttttgaaatttttgcaattattttaagaatccagtctttcagaccagcccttttattaagctttgaatttttaattgatttttttaaagtaaaaaaaaaaaaaacccaaaaaacaaacaaaatttaacaaaaaaatccgctactcttactcccctgcctccccctaccccagcccatgagagttcccttgcactcccctctgcctttgcaactgatcatcctccctttctccttggcttgaagcatctatgtccagtatctgtgaaatgatgttttatctgtgtgtcaggatgagaaacggcagtcattccaccaagtgttggaaactggttagcctggagacaagggtttctggggccacagctcagggatgtgtatttaattacaggatccccagaaactcctctctaggctgccacagcaacattttttctgggcttgggagccatacctgaactgtttcctccaaggcgggaactccagagagcctgccaagtctggagcaagctggggcttctgctttggccagacctgggccaccatgagacttgaaggcttctagctgtcctacgacacgagccacggtggccctgcctctccccgctcatagaagcctggtccctctgtctagcccagttcccatctagcatccgtcttctgggcctgaagccctaaatggaccacagcctgcacaggaatcaactgtaggctcaaagggaggcggtgagtaaggtcagagcctgctccaagcccaagaacaaaagttgtgttatgggtggaggctagtcccccagatctagccctgccgtctttgccctttaatgaccattgttttctttctctaaaatgtcttgtaataggtgataatgttgttgattcaaatttccatgaaaaagaaaaaaaaaactacctcttaagcgacatcctggtcgattcctctctgaggaatcctgtgggaaaagaatactgtagctcctgctctgtttacatgtttctgtcgggaaagaagccccgcctgccctggggtgttggtgtttttgtctgtgttgccatcccaggtctgccataggggctggtggctgcattgtgatgtctgggctgtgtctggggattccttcccacctacccagccagggactagtcacccccctgaagaggcctccatttccttcctgtgctccagggcatagggagcaccactcccacagacaccacctttaagggctctagtggcacacacatccacgagcctacccccaggttacctgccctaggtccacctccacccacagtcctgtgtgtaggaatcgaggaaacgggatgtccctgagcccttgtctccaaagggccggccaagggctgcccgccagcctgactccatcaaccctccatgaccaaatgatagctggcgggctctgcaggctacccaggccctctgctacctcccaccctgccagctggcaagggatgggccctgttctgtgaattgactacctgtggaaatgtgaccaattagtgtgaaatgcatgtttagcaagtgttaggtactgtatttgaaccaataaatgtgaatccttctgcacatgg

SEQ ID NO: 160997 - DNA, 742 bp, Homo sapiens
  Payload ID: 11449
  Gene Symbol: NR6A1
  Gene Name: nuclear receptor subfamily 6, group A, member 1
  ENST ID: ENST00000475178
  CDS Start-End: 45-742
catggctgcaatagaacttttcagcagactacaagaagcatgaaatggagacatgggaagtttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatgg

SEQ ID NO: 160998 - DNA, 2424 bp, Homo sapiens
  Payload ID: 11450
  Gene Symbol: NRF1
  Gene Name: nuclear respiratory factor 1
  Uniprot ID: Q16656
  ENST ID: ENST00000223190
  CDS Start-End: 79-1590
gaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtca

SEQ ID NO: 160999 - DNA, 2481 bp, Homo sapiens
  Payload ID: 11450
  Gene Symbol: NRF1
  Gene Name: nuclear respiratory factor 1
  Uniprot ID: Q16656
  ENST ID: ENST00000311967
  CDS Start-End: 79-1647
gaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctctttatggcagatcgtgcaggtcgcaagtggatcctgactgacaaagccacaggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtca

SEQ ID NO: 161000 - DNA, 3568 bp, Homo sapiens
  Payload ID: 11450
  Gene Symbol: NRF1
  Gene Name: nuclear respiratory factor 1
  Uniprot ID: Q16656
  ENST ID: ENST00000353868
  CDS Start-End: 101-1669
ttcctggtccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctctttatggcagatcgtgcaggtcgcaagtggatcctgactgacaaagccacaggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacagg

SEQ ID NO: 161001 - DNA, 3523 bp, Homo sapiens
  Payload ID: 11450
  Gene Symbol: NRF1
  Gene Name: nuclear respiratory factor 1
  Uniprot ID: Q16656
  ENST ID: ENST00000393230
  CDS Start-End: 111-1622
cccctttcagttcctggtccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaggaa

SEQ ID NO: 161002 - DNA, 3528 bp, Homo sapiens
  Payload ID: 11450
  Gene Symbol: NRF1
  Gene Name: nuclear respiratory factor 1
  Uniprot ID: Q16656
  ENST ID: ENST00000393232
  CDS Start-End: 118-1629
ggcggcagaagcggcagcgctcgccattgccgctggtggcaggaggctgcgaggagccggcgcggtcgcagtctccacggcgcaggcccacggtagcgcagccgctctgagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacagg

SEQ ID NO: 161003 - DNA, 814 bp, Homo sapiens
  Payload ID: 11450
  Gene Symbol: NRF1
  Gene Name: nuclear respiratory factor 1
  ENST ID: ENST00000454688
  CDS Start-End: 186-814
tggtggcaggaggctgcgaggagccggcgcggtcgcagtctccacggcgcaggcccacggtagcgcagccgctctgaggctggagtgcagtggtgtgatctcggctctctgcaacttccacatcccgggttcaagcgattctactgcctcagcctcccgagtagttgggactacagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatccc

SEQ ID NO: 161004 - DNA, 2346 bp, Homo sapiens
  Payload ID: 11451
  Gene Symbol: NXF1
  Gene Name: nuclear RNA export factor 1
  Uniprot ID: Q9UBU9
  ENST ID: ENST00000294172
  CDS Start-End: 137-1996
cggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatttc

SEQ ID NO: 161005 - DNA, 589 bp, Homo sapiens
  Payload ID: 11451
  Gene Symbol: NXF1
  Gene Name: nuclear RNA export factor 1
  ENST ID: ENST00000533671
  CDS Start-End: 244-589
actcgaggtggacacccgagttgttgactcctggattcctgctggcatcctggtgttgggggacctgcggctcggagcggatggctcggggaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtca

SEQ ID NO: 161006 - DNA, 572 bp, Homo sapiens
  Payload ID: 11451
  Gene Symbol: NXF1
  Gene Name: nuclear RNA export factor 1
  ENST ID: ENST00000525576
  CDS Start-End: 85-315
acttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacg

SEQ ID NO: 161007 - DNA, 619 bp, Homo sapiens
  Payload ID: 11451
  Gene Symbol: NXF1
  Gene Name: nuclear RNA export factor 1
  ENST ID: ENST00000527902
  CDS Start-End: 1-374
acataagcgcccagacaagcacattgctgtgtttttctgtcaatggagtcttcaaggaagtggacggaaagtcccgggattctttgcgagccttcacccggacattcattgctgttcctgctagcaattcaggttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttag

SEQ ID NO: 161008 - DNA, 1922 bp, Homo sapiens
  Payload ID: 11451
  Gene Symbol: NXF1
  Gene Name: nuclear RNA export factor 1
  ENST ID: ENST00000530875
  CDS Start-End: 114-1922
ataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgtttctacttcatttttcaaaagccctacacagttttccagtaacttttccctgatgctgccctcccacagagagggttctttcctgtggatagggagcggagtttgcatggagatggcctctgtcgttaaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtg

SEQ ID NO: 161009 - DNA, 2795 bp, Homo sapiens
  Payload ID: 11451
  Gene Symbol: NXF1
  Gene Name: nuclear RNA export factor 1
  Uniprot ID: Q9UBU9
  ENST ID: ENST00000532297
  CDS Start-End: 631-2490
atagagacaacagtcaggggctggtggtggtgcttttgggggtctaggagagcccaaggccctgatattttaaaatgtcctcctcggcatctccagcaagttgccactgctggcgaagaaagcgaggtatagacaaggagccgagctgaaacactggctagattccggtaggggtctgagccatcactcccacctggaggcgcggtctccattcctctgaagccctttgtgcggcccccttcctcactgagttctgggctgcggcggcagcactgtgctctagcactaactctgaagctgccagggcagcgtcagcggacagatgaaaaggtgcggggacatgctggctgccagccggggttccgcaagttcaggtcttgggcggggcgtggagggccaggccccgcccctcgaacgacggccttaagtgtgcgcacgcgcagggggccgcgctttctccgggcggcggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgta

SEQ ID NO: 161010 - DNA, 548 bp, Homo sapiens
  Payload ID: 11451
  Gene Symbol: NXF1
  Gene Name: nuclear RNA export factor 1
  ENST ID: ENST00000531474
  CDS Start-End: 360-548
tacacagttttccagtaacttttccctgatgctgccctcccacagagagggttctttcctgtggatagggagcggagtttgcatggagatggcctctgtcgttagtatgtatctcttccaatagttcagagtactagaagctatgattgccacaccaaaccggaccagttacttacttctaatttgtgttcctgtttctaactctagaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattaca

SEQ ID NO: 161011 - DNA, 4128 bp, Homo sapiens
  Payload ID: 11451
  Gene Symbol: NXF1
  Gene Name: nuclear RNA export factor 1
  Uniprot ID: Q9UBU9
  ENST ID: ENST00000531709
  CDS Start-End: 115-1185
tataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcgccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcaggtgctgggcgtggaggccacgggggcataggctaccaaggagacagagaactgaccccctcgggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttgggggcaacagaggtggggcatggaccctcacccccacaatcctacaggggcctgaaccctcacaccttctgagggaggtctcctgcccccatggctgctttgcttcccacgcccagttcagatcgggacccaggtagcagacagagacctggccaacagcaagtgcccactcaccacagcaaggatttgtttctcatttctaccttggaccacagggatggggcagctgaaagaaagggctgtgtcagggtgtctttctcccttttctccctcatttttctagatgcttttttgccttgtagttctttctctttttctttgctttctctttcctttttctgtctgtctcctatacctccccatctctcccttgcccctgccccatcttgcctttttctctttttcctccttttcctttcttattcctttgcctctcctcttcctgagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatttcgtg

SEQ ID NO: 161012 - DNA, 1023 bp, Homo sapiens
  Payload ID: 11451
  Gene Symbol: NXF1
  Gene Name: nuclear RNA export factor 1
  ENST ID: ENST00000531131
  CDS Start-End: 155-814
acttcggtcctgagcgcttgggagttaggttgtttgccggcgtagcggccagcgcctgagcccgcccttgatcttcgctgtggcatggcggacgaggggaagtcgtacagcgattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctag

SEQ ID NO: 161013 - DNA, 2143 bp, Homo sapiens
  Payload ID: 11452
  Gene Symbol: NXF2
  Gene Name: nuclear RNA export factor 2
  Uniprot ID: Q9GZY0
  ENST ID: ENST00000604790
  CDS Start-End: 58-1938
tcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgt

SEQ ID NO: 161014 - DNA, 2337 bp, Homo sapiens
  Payload ID: 11452
  Gene Symbol: NXF2
  Gene Name: nuclear RNA export factor 2
  Uniprot ID: Q9GZY0
  ENST ID: ENST00000625106
  CDS Start-End: 254-2134
aagattgcgtcttgtttgtggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 161015 - DNA, 2322 bp, Homo sapiens
  Payload ID: 11453
  Gene Symbol: NXF2B
  Gene Name: nuclear RNA export factor 2B
  Uniprot ID: Q9GZY0
  ENST ID: ENST00000602195
  CDS Start-End: 239-2119
ttgtggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 161016 - DNA, 2143 bp, Homo sapiens; identical to SEQ ID NO: 161013
  Payload ID: 11453
  Gene Symbol: NXF2B
  Gene Name: nuclear RNA export factor 2B
  Uniprot ID: Q9GZY0
  ENST ID: ENST00000604395
  CDS Start-End: 58-1938

SEQ ID NO: 161017 - DNA, 3193 bp, Homo sapiens
  Payload ID: 11453
  Gene Symbol: NXF2B
  Gene Name: nuclear RNA export factor 2B
  ENST ID: ENST00000618881
  CDS Start-End: 1670-2899
cctgactcacctagctcctcctgcagcatggcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagggatgatgcttcctgtctgtcacaaggctgagtgaacacaacatgcctgtaggtccagaacattcttcctacagagaccagatgtccagaaagccctatctgctggattcagggaacgcctctcctcatttctgtcagcactatttgcaaaagcctccttctctgagatcttcaaagctgcagttctagccacagtctgcagggagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcagtcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgta

SEQ ID NO: 161018 - DNA, 2884 bp, Homo sapiens
  Payload ID: 11453
  Gene Symbol: NXF2B
  Gene Name: nuclear RNA export factor 2B
  Uniprot ID: Q9GZY0
  ENST ID: ENST00000618302
  CDS Start-End: 801-2681
cctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 161019 - DNA, 1938 bp, Homo sapiens
  Payload ID: 11454
  Gene Symbol: NXF3
  Gene Name: nuclear RNA export factor 3
  Uniprot ID: Q9H4D5
  ENST ID: ENST00000395065
  CDS Start-End: 103-1698
ttgctctcgccttcgtcagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgcaaaa

SEQ ID NO: 161020 - DNA, 1081 bp, Homo sapiens
  Payload ID: 11454
  Gene Symbol: NXF3
  Gene Name: nuclear RNA export factor 3
  ENST ID: ENST00000427570
  CDS Start-End: 1-1081
caatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtctcagggttctgttctcgccttcacccggaccttcattgctacccctggcagcagttccagtctgtgcatcgt

SEQ ID NO: 161021 - DNA, 2062 bp, Homo sapiens
  Payload ID: 11455
  Gene Symbol: NXF5
  Gene Name: nuclear RNA export factor 5
  Uniprot ID: Q9H1B4
  ENST ID: ENST00000263032
  CDS Start-End: 361-1554
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtggtggtgtttgttgtctctgaagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 161022 - DNA, 1967 bp, Homo sapiens
  Payload ID: 11455
  Gene Symbol: NXF5
  Gene Name: nuclear RNA export factor 5
  Uniprot ID: Q9H1B4
  ENST ID: ENST00000332614
  CDS Start-End: 361-1269
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtgggtaggaggttaaggaggatcctgagcacctgagcgcttccttttcaggaaaggatgctctgcttttctgtcaacggagtgttcaaggaaggtggtggtgtttgttgtctctgaagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 161023 - DNA, 1848 bp, Homo sapiens
  Payload ID: 11455
  Gene Symbol: NXF5
  Gene Name: nuclear RNA export factor 5
  Uniprot ID: Q9H1B4
  ENST ID: ENST00000361330
  CDS Start-End: 361-1278
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 161024 - DNA, 2037 bp, Homo sapiens
  Payload ID: 11455
  Gene Symbol: NXF5
  Gene Name: nuclear RNA export factor 5
  Uniprot ID: Q9H1B4
  ENST ID: ENST00000372803
  CDS Start-End: 361-1467
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 161025 - DNA, 1973 bp, Homo sapiens
  Payload ID: 11455
  Gene Symbol: NXF5
  Gene Name: nuclear RNA export factor 5
  Uniprot ID: Q9H1B4
  ENST ID: ENST00000493509
  CDS Start-End: 361-867
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 161026 - DNA, 1348 bp, Homo sapiens
  Payload ID: 11455
  Gene Symbol: NXF5
  Gene Name: nuclear RNA export factor 5
  Uniprot ID: Q9H1B4
  ENST ID: ENST00000473265
  CDS Start-End: 182-1279
acttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagcctaagaccactctaaggactggggttggaggcctggctgaccaagaagccaaagttaacttgcaggccacaggacatagccacc

SEQ ID NO: 161027 - DNA, 1991 bp, Homo sapiens
  Payload ID: 11455
  Gene Symbol: NXF5
  Gene Name: nuclear RNA export factor 5
  Uniprot ID: Q9H1B4
  ENST ID: ENST00000537026
  CDS Start-End: 290-1483
agaatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtggtggtgtttgttgtctctgaagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 161028 - DNA, 2541 bp, Homo sapiens
  Payload ID: 11456
  Gene Symbol: NSRP1
  Gene Name: nuclear speckle splicing regulatory protein 1
  Uniprot ID: Q9H0G5
  ENST ID: ENST00000247026
  CDS Start-End: 64-1740
cgtgacgacatcggcgtcagcgtcacggaggcgtcggccacgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttatacatttta

SEQ ID NO: 161029 - DNA, 1800 bp, Homo sapiens
  Payload ID: 11456
  Gene Symbol: NSRP1
  Gene Name: nuclear speckle splicing regulatory protein 1
  ENST ID: ENST00000394826
  CDS Start-End: 25-177
acgttcagcggacacgggagcaagatggcgattccgggcaggcaatggggtttcactcttgttgcccaggctggagtgcaatggtgcaatctcggctcaccgcaacctccacctcctgggttcaagcgattttcctgcctcagcctcccaaatagctgcaattacagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaacc

SEQ ID NO: 161030 - DNA, 583 bp, Homo sapiens
  Payload ID: 11456
  Gene Symbol: NSRP1
  Gene Name: nuclear speckle splicing regulatory protein 1
  ENST ID: ENST00000584154
  CDS Start-End: 26-154
cacgttcagcggacacgggagcaagatggcgattccgggcaggcagtatgggcttattttgccaaagaaaacacagcagttgcaccctgttttgcaaaaaccatcagtgtttgggaatgattctgatgatgatgatgaggtttttggcatttaatcgtcatccttagtggtaattgttaaagtacctttatttagaaaattgagaatcaaatgaccttcaaaagatcatcagtttttcctgactttttcagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataa

SEQ ID NO: 161031 - DNA, 564 bp, Homo sapiens
  Payload ID: 11456
  Gene Symbol: NSRP1
  Gene Name: nuclear speckle splicing regulatory protein 1
  ENST ID: ENST00000584317
  CDS Start-End: 15-239
gacacgggagcaagatggcgattccgggcaggcagtatgggcttattttgccaaagaaaacacagcagttgcaccctgttttgcaaaaaccatcagtgtttgggaatgattctgatgatgatgatgagatggggtttcactcttgttgcccaggctggagtgcaatggtgcaatctcggctcaccgcaacctccacctcctgggttcaagcgattttcctgcctcagcctcccaaatagctgcaattacagtagagacggggcttcatcaggttggccacgctgatctcaaactcctgagctcaagtgatccagccgcctcagcctcccaaagcgctgggattacagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcag

SEQ ID NO: 161032 - DNA, 482 bp, Homo sapiens
  Payload ID: 11456
  Gene Symbol: NSRP1
  Gene Name: nuclear speckle splicing regulatory protein 1
  ENST ID: ENST00000584423
  CDS Start-End: 64-342
cgtgacgacatcggcgtcagcgtcacggaggcgtcggccacgttcagcggacacgggagcaagatggcgattccgggcaggcagtatgggcttattttgccaaagaaaacacagcagttgcaccctgttttgcaaaaaccatcagtgtttgggaatgattctgatgatgatgatgaggatcttgctctttcacccaggatggagtgcaatttgtgcagtcacaactcatggcagcctcaacctcccaggccgaagcacgcctctcacctcagcctcccaagtagctgggaccacaggcacacaccaccatgcctggctaattttttaatttattttttgtagagacagagtctcactgcgttgcctaggctgctcttgaactcctgggctcaagtgatccacctgctttggcctcccaaagtgttgggcttataggtgtgagccactgcacctggctgtgaacttagtatgtgtatatatgt

SEQ ID NO: 161033 - DNA, 1242 bp, Homo sapiens
  Payload ID: 11456
  Gene Symbol: NSRP1
  Gene Name: nuclear speckle splicing regulatory protein 1
  ENST ID: ENST00000475652
  CDS Start-End: 16-141
ggacacgggagcaagatggcgattccgggcaggcagaatattgttctgagaagccacagaaaaagggtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaa

SEQ ID NO: 161034 - DNA, 582 bp, Homo sapiens
  Payload ID: 11456
  Gene Symbol: NSRP1
  Gene Name: nuclear speckle splicing regulatory protein 1
  ENST ID: ENST00000585881
  CDS Start-End: 390-582
cgagaagtcctgaggaacatagattcccctcccccgtacattttcccggatggaagcccgaagtttgagggagaaacttgtgaggaaataaaggaagttaggctgaggggcagagagcgagacttttctattttccaaaagctcggtctgaggcccctcagtcttgcttcctaacccgcgcttgagtttctccccgcttggatgctctcaggggcagtgtgaagagagacagttcctggcttccttagagggccttgttctccttggcagaagctcaagtcctgattcccgcccttccttctcgttttaggaatattgttctgagaagccacagaaaaaggacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacagg

SEQ ID NO: 161035 - DNA, 497 bp, Homo sapiens
  Payload ID: 11456
  Gene Symbol: NSRP1
  Gene Name: nuclear speckle splicing regulatory protein 1
  ENST ID: ENST00000588614
  CDS Start-End: 185-497
aacataaaggtttaatttctatttcaaaaaaaatatatgcaggtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaag

SEQ ID NO: 161036 - DNA, 540 bp, Homo sapiens
  Payload ID: 11456
  Gene Symbol: NSRP1
  Gene Name: nuclear speckle splicing regulatory protein 1
  ENST ID: ENST00000479218
  CDS Start-End: 18-143
gcggacacgggagcaagatggcgattccgggcaggcagaatattgttctgagaagccacagaaaaagggtatgggcttattttgccaaagaaaacacagcagttgcaccctgttttgcaaaaaccatcagtgtttgggaatgattctgatgatgatgatgaggatcttgctctttcacccaggatggagtgcaatttgtgcagtcacaactcatggcagcctcaacctcccaggccgaagcacgcctctcacctcagcctcccaagtagctgggaccacaggcacacaccaccatgcctggctaattttttaatttattttttgtagagacagagtctcactgcgttgcctaggctgctcttgaactcctgggctcaagtgatccacctgctttggcctcccaaagtgttgggcttataggtgtgagccactgcacctggctgtgaacttagtatgtgtatatatgtatatgtagttatatatatatataaaattatatatataaaattactcagaagccatagtatattccttttatag

SEQ ID NO: 161037 - DNA, 368 bp, Homo sapiens
  Payload ID: 11456
  Gene Symbol: NSRP1
  Gene Name: nuclear speckle splicing regulatory protein 1
  ENST ID: ENST00000589608
  CDS Start-End: 1-205
gtatgggcttattttgccaaagaaaacacagcagttgcaccctgttttgcaaaaaccatcagtgtttgggaatgattctgatgatgatgatgagatggggtttcactcttgttgcccaggctggagtgcaatggtgcaatctcggctcaccgcaacctccacctcctgggttcaagcgattttcctgcctcagcctcccaaatagctgcaattacagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaa

SEQ ID NO: 161038 - DNA, 774 bp, Homo sapiens
  Payload ID: 11456
  Gene Symbol: NSRP1
  Gene Name: nuclear speckle splicing regulatory protein 1
  ENST ID: ENST00000580103
  CDS Start-End: 304-774
cttgagtttctccccgcttggatgctctcaggggcagtgtgaagagagacagttcctggcttccttagagggccttgttctccttggcagaagctcaagtcctgattcccgcccttccttctcgttttaggaatattgttctgagaagccacagaaaaagggtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaa

SEQ ID NO: 161039 - DNA, 2420 bp, Homo sapiens
  Payload ID: 11456
  Gene Symbol: NSRP1
  Gene Name: nuclear speckle splicing regulatory protein 1
  ENST ID: ENST00000612959
  CDS Start-End: 106-1620
ggaggcgtcggccacgttcagcggacacgggagcaagatggcgattccgggcaggcaacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttatacatttt

SEQ ID NO: 161040 - DNA, 1660 bp, Homo sapiens
  Payload ID: 11457
  Gene Symbol: NFYA
  Gene Name: nuclear transcription factor Y, alpha
  Uniprot ID: P23511
  ENST ID: ENST00000353205
  CDS Start-End: 164-1120
cggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttc

SEQ ID NO: 161041 - DNA, 3811 bp, Homo sapiens
  Payload ID: 11457
  Gene Symbol: NFYA
  Gene Name: nuclear transcription factor Y, alpha
  Uniprot ID: P23511
  ENST ID: ENST00000341376
  CDS Start-End: 202-1245
gattcccctttgttcgggttcgccattttgctaggcagcggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcagcagcagggtggtgtcactgctgtgcagttgcagactgaggcccaggtggcatccgcctcaggccagcaagtccagaccctccaggtagtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgcttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaa

SEQ ID NO: 161042 - DNA, 3512 bp, Homo sapiens
  Payload ID: 11458
  Gene Symbol: NFYB
  Gene Name: nuclear transcription factor Y, beta
  Uniprot ID: P25208
  ENST ID: ENST00000240055
  CDS Start-End: 229-852
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgtaaa

SEQ ID NO: 161043 - DNA, 1727 bp, Homo sapiens
  Payload ID: 11458
  Gene Symbol: NFYB
  Gene Name: nuclear transcription factor Y, beta
  Uniprot ID: P25208
  ENST ID: ENST00000551727
  CDS Start-End: 722-1345
tcccgccctcccgcgcgggccgaggccgggccccgcgcctgcgaggccgctcccgcagcgggccgggccggggagcgggcgcggggccgcggcgcggctctttgtgcgccgggctgaggagcggcgggacgcgggccaggccacctcaccctcgccgccgttgagctccgggcccggggccgaggaggggccgcggggctgcgtcggggccccgctctcgacggcgtcccgggccggctccattttgtgcggggagccggccgaggggcgggagacgcggcccgggccctggccccgtagccccggcggcggcgcgagtccccgggggcgccctcctcccgcccgcggggctgtggcggggcccggcgctttgtctgcccgcacatcccgggggccgcgcggcgggtgggaggcaggcgttgggcgcggggccggggcggccgggcgagtcaggggatgcgctctgggggcggcctcctggcactcgcagggctgacaggtcgccgggaccaggccgtggggccggggccacccaggcacctgcgtggggaggaaggcatggctttagcttccccgcagcctggtttgcgcgtaaagaatgcagccatctggcggtttgcggtccctgtacttgccccgaaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgttt

SEQ ID NO: 161044 - DNA, 618 bp, Homo sapiens
  Payload ID: 11458
  Gene Symbol: NFYB
  Gene Name: nuclear transcription factor Y, beta
  ENST ID: ENST00000551446
  CDS Start-End: 225-618
agccattttctgtccaaccaaacagccgattggagacgggagccaaccagggctgcattggaggttgaaatcacaaagattagacacctttttagataggtgttcttcagcaccactgacaacacggttctgacagtatttcatgacagttatgtaacatttgtcctgcaagctgaggacagagaccttgtctgttgttgacagctacgtgaccagcacatagcatgaacctgatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatg

SEQ ID NO: 161045 - DNA, 2158 bp, Homo sapiens
  Payload ID: 11459
  Gene Symbol: NFYC
  Gene Name: nuclear transcription factor Y, gamma
  Uniprot ID: Q13952
  ENST ID: ENST00000308733
  CDS Start-End: 7-1383
gtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacaggggcaaagaaatgcaagtcaggggaagcctcgaaggtgcctgaaagaaaccttacagattacacagacagaggtccagcaaggacagcagcagttcagccagttcacagatggacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 161046 - DNA, 1202 bp, Homo sapiens
  Payload ID: 11459
  Gene Symbol: NFYC
  Gene Name: nuclear transcription factor Y, gamma
  Uniprot ID: Q13952
  ENST ID: ENST00000372651
  CDS Start-End: 83-1090
gggataggagtgacttaaattctcccagtcggtggaggtataaataactacatgtaaaattaatgcagttcccgttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgc

SEQ ID NO: 161047 - DNA, 2363 bp, Homo sapiens
  Payload ID: 11459
  Gene Symbol: NFYC
  Gene Name: nuclear transcription factor Y, gamma
  Uniprot ID: Q13952
  ENST ID: ENST00000372652
  CDS Start-End: 269-1588
cagggcttcattggagcctcggagtttttcactgaggcaggggtcagctgaaagacaaagaaaaatggcgaatagtttgttggggggtgggaggacagctgttcgggttttcagtggagtggacattccagactcatgtttctgcatctcctgctgccttttgtttcctccgtcctttggggggtagggataggagtgacttaaattctcccagtcggtggaggtataaataactacatgtaaaattaatgcagttcccgttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 161048 - DNA, 1862 bp, Homo sapiens
  Payload ID: 11459
  Gene Symbol: NFYC
  Gene Name: nuclear transcription factor Y, gamma
  Uniprot ID: Q13952
  ENST ID: ENST00000372653
  CDS Start-End: 679-1584
gtgctcttgcctggcccgctgctgtcgccgccgccgcgctcgtggggtccgtgtgcctcgtcggcccggcccgcgggctttctcccattggcggaaggcgacggcgggggggctcgctcgtgattggtcggtggcggggaggccgcggacctggcaccttattggacgcgccagctccggtctaggggacacgggcttccaccatgttagccaggctggtcttcaactcctgacctcaggtgatccacccacctcggcctcccaaagtgctgggattataggcgtgagccaccgtgcccagccaggctatgctgggtgtctttttgagatttaggaacctctcagaataaaatctggaagcctgttccatttgcattatgagatttgcattacaatgcaggctgaagtgcagtagtgcaatcatggctcattgcagtctcccagctcctcggctcaagtgatcctcctgccccagcctcctgagtagcgggagctacagacacacaaacacaggatactgccagaaactgggcaagaggctgtttgtgaatctcagaaggcacccggatcttgctctgctgttcctgctcaggctggagtgcagtggcgcaatcatggctcactgcaggcttgaccacccaggctcaagcagtcctcccgcctcagcctcttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataac

SEQ ID NO: 161049 - DNA, 1455 bp, Homo sapiens
  Payload ID: 11459
  Gene Symbol: NFYC
  Gene Name: nuclear transcription factor Y, gamma
  Uniprot ID: Q13952
  ENST ID: ENST00000372654
  CDS Start-End: 174-1181
ctcctgctcttcctggactcctgagcagagacgaggtctcgctctgttgccaaggctggtgtgccaggctggagtgccgtggcatgatcatgactcactgcagcctccacctcctgggctcaagcaatcctcctacttcagcctcctgagtagctgggactacagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaa

SEQ ID NO: 161050 - DNA, 1005 bp, Homo sapiens
  Payload ID: 11459
  Gene Symbol: NFYC
  Gene Name: nuclear transcription factor Y, gamma
  ENST ID: ENST00000372669
  CDS Start-End: 67-1005
gcggcgagagggcgagcctagaggctttaagggggaagagagggtgatggcctggcagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggagacaggtcttgctgtgtcactcagactgatgaagtgcagtggcttgatctcagctcactgcagcttccgcctcccaggttcaagcgattctcctgcctcagcctcccgagtagctgggattataggtgcagctgaatgccggccagctgcagtatatccgcttagcccagcctgtatcaggcactcaagttgtgcagggacagatccagacacttgc

SEQ ID NO: 161051 - DNA, 1536 bp, Homo sapiens
  Payload ID: 11459
  Gene Symbol: NFYC
  Gene Name: nuclear transcription factor Y, gamma
  Uniprot ID: Q13952
  ENST ID: ENST00000425457
  CDS Start-End: 161-1225
gccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacaggggcaaagaaatgcaagtcaggggaagcctcgaaggtgcctgaaagaaaccttacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttg

SEQ ID NO: 161052 - DNA, 650 bp, Homo sapiens
  Payload ID: 11459
  Gene Symbol: NFYC
  Gene Name: nuclear transcription factor Y, gamma
  ENST ID: ENST00000453631
  CDS Start-End: 264-650
ccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagaggatcttgctctgctgttcctgctcaggctggagtgcagtggcgcaatcatggctcactgcaggcttgaccacccaggctcaagcagtcctcccgcctcagcctcttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcag

SEQ ID NO: 161053 - DNA, 1950 bp, Homo sapiens
  Payload ID: 11459
  Gene Symbol: NFYC
  Gene Name: nuclear transcription factor Y, gamma
  Uniprot ID: Q13952
  ENST ID: ENST00000447388
  CDS Start-End: 168-1175
cggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 161054 - DNA, 1379 bp, Homo sapiens
  Payload ID: 11459
  Gene Symbol: NFYC
  Gene Name: nuclear transcription factor Y, gamma
  Uniprot ID: Q13952
  ENST ID: ENST00000427410
  CDS Start-End: 188-1081
aaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttg

SEQ ID NO: 161055 - DNA, 1911 bp, Homo sapiens
  Payload ID: 11459
  Gene Symbol: NFYC
  Gene Name: nuclear transcription factor Y, gamma
  Uniprot ID: Q13952
  ENST ID: ENST00000456393
  CDS Start-End: 134-1138
cgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagat

SEQ ID NO: 161056 - DNA, 547 bp, Homo sapiens
  Payload ID: 11459
  Gene Symbol: NFYC
  Gene Name: nuclear transcription factor Y, gamma
  ENST ID: ENST00000416859
  CDS Start-End: 9-547
ttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagc

SEQ ID NO: 161057 - DNA, 1717 bp, Homo sapiens
  Payload ID: 11459
  Gene Symbol: NFYC
  Gene Name: nuclear transcription factor Y, gamma
  Uniprot ID: Q13952
  ENST ID: ENST00000440226
  CDS Start-End: 445-1452
ttaatacattttcagttccaaaaaaatttgataacttctgttttgtacctaacttccactactacagtatgtggctctgagccagccaaagattcatgatctgttgactacacagatgtttgcgggctgatcatgcctgcacatctgtagttgggacagttcaaaatttaaaagcagactgcacagatggttctagacgtgctttttgaattgtgtacctttgtaatgttttggggggatatcagaggacagccagaatttgttaccagacttttaaatcgtacaggtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaa

SEQ ID NO: 161058 - DNA, 677 bp, Homo sapiens
  Payload ID: 11459
  Gene Symbol: NFYC
  Gene Name: nuclear transcription factor Y, gamma
  ENST ID: ENST00000414185
  CDS Start-End: 1-559
tccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 161059 - DNA, 293 bp, Homo sapiens
  Payload ID: 11459
  Gene Symbol: NFYC
  Gene Name: nuclear transcription factor Y, gamma
  ENST ID: ENST00000530965
  CDS Start-End: 9-293
ttgtcgagatgtccacagaaggaggatttggtggtactagcagcagtgatgcccagcaaagcctacagtcgttctggcctcgggtcatggaagaaatccggaatttaacagtgatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttcca

SEQ ID NO: 161060 - DNA, 574 bp, Homo sapiens
  Payload ID: 11459
  Gene Symbol: NFYC
  Gene Name: nuclear transcription factor Y, gamma
  ENST ID: ENST00000534399
  CDS Start-End: 419-574
atgttgtgctcttgcctggcccgctgctgtcgccgccgccgcgctcgtggggtccgtgtgcctcgtcggcccggcccgcgggctttctcccattggcggaaggcgacggcgggggggctcgctcgtgattggtcggtggcggggaggccgcggacctggcaccttattggacgcgccagctccggtctaggggacacacaaacacaggatactgccagaaactgggcaagaggctgtttgtgaatctcagaaggcacccggtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatg

SEQ ID NO: 161061 - DNA, 525 bp, Homo sapiens
  Payload ID: 11459
  Gene Symbol: NFYC
  Gene Name: nuclear transcription factor Y, gamma
  ENST ID: ENST00000531464
  CDS Start-End: 345-525
ctttttctcttttttcctggtgagaagaacttgtgtccttcaaaagaagattacctttgtctttcgaagtcaggaatttataaaaagagtttgctggatggaaaaatcataaaggccataactctaaaacctaatgtaaagaagaacagttagagctgtccaaagatgggaaagaatgtcttaccagtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatga

SEQ ID NO: 161062 - DNA, 433 bp, Homo sapiens
  Payload ID: 11459
  Gene Symbol: NFYC
  Gene Name: nuclear transcription factor Y, gamma
  ENST ID: ENST00000525290
  CDS Start-End: 11-433
agttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggtgcgccagtctgtaactcctgccgagccagtc

SEQ ID NO: 161063 - DNA, 1314 bp, Homo sapiens
  Payload ID: 11459
  Gene Symbol: NFYC
  Gene Name: nuclear transcription factor Y, gamma
  ENST ID: ENST00000620728
  CDS Start-End: 613-1314
agatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcgggccaggacctcgcccagcccatgttcatccagtcagccaaccagccctccgacgggccccccaggtgaccggcgactgagggcctga

SEQ ID NO: 161064 - DNA, 3513 bp, Homo sapiens
  Payload ID: 11460
  Gene Symbol: NFX1
  Gene Name: nuclear transcription factor, X-box binding 1
  Uniprot ID: Q12986
  ENST ID: ENST00000318524
  CDS Start-End: 29-2530
cagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagcagtcccactactgggcgtctacccagaagaaaagaagtcattatatgaaaaagatacctgcacacgcatgtttatagcagcacaattcacaattgcaaaaatgtggaaccagcccaactgcccatcagtcaacaagtggataaagaaattgtggtgtatctatacgtaccatggaatactactcagccaggaacgaaataatggcattcacagcaacctggatggatttggagaccattattctaagtgaagtaactcaggaatggaaaaccaaacatcgtatgttctcaattataagagggagctaagctatgaggacgcaaaggcatgagaatgatacaatggactttggggactctggggaaaggacgggaggcgggtgagggataaaaaactacacactgggtccgagcacggtggctcatgcctataatcccagcactttgggaggccaaggcaggtagattatgaggtcgggagttcgaaaccagcctggccaacaaggtgagaccccccccatctctactaaaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataa

SEQ ID NO: 161065 - DNA, 3609 bp, Homo sapiens
  Payload ID: 11460
  Gene Symbol: NFX1
  Gene Name: nuclear transcription factor, X-box binding 1
  Uniprot ID: Q12986
  ENST ID: ENST00000379521
  CDS Start-End: 62-3136
acgtgacctggtgacagtgctgacttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaa

SEQ ID NO: 161066 - DNA, 4604 bp, Homo sapiens
  Payload ID: 11460
  Gene Symbol: NFX1
  Gene Name: nuclear transcription factor, X-box binding 1
  Uniprot ID: Q12986
  ENST ID: ENST00000379540
  CDS Start-End: 63-3425
cacgtgacctggtgacagtgctgacttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 161067 - DNA, 3723 bp, Homo sapiens
  Payload ID: 11461
  Gene Symbol: NFXL1
  Gene Name: nuclear transcription factor, X-box binding-like 1
  Uniprot ID: Q6ZNB6
  ENST ID: ENST00000329043
  CDS Start-End: 58-2793
ggaacgcgggcgggggcttctgggagttgtagtctgttgggggcgtgcgcagtcgggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaatttgtaa

SEQ ID NO: 161068 - DNA, 3728 bp, Homo sapiens
  Payload ID: 11461
  Gene Symbol: NFXL1
  Gene Name: nuclear transcription factor, X-box binding-like 1
  Uniprot ID: Q6ZNB6
  ENST ID: ENST00000381538
  CDS Start-End: 70-2805
gtcggtaaggagacgtagctttccgtggggtgtaccactgcagttggttcccggcgggagacgcaggggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaa

SEQ ID NO: 161069 - DNA, 3833 bp, Homo sapiens
  Payload ID: 11461
  Gene Symbol: NFXL1
  Gene Name: nuclear transcription factor, X-box binding-like 1
  Uniprot ID: Q6ZNB6
  ENST ID: ENST00000507489
  CDS Start-End: 178-2913
gactcttcccctaccacgctcccgcagaggctgaggaggcggtttcgacttctcctccggctttctgtcttcggcactgtgtgcttcttgctccgcggtttatttctgtacctagtcctccctcccctcttcggtccatctccaaagcccgggcttggcggggactcgccctccgggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgatacc

SEQ ID NO: 161070 - DNA, 3865 bp, Homo sapiens
  Payload ID: 11461
  Gene Symbol: NFXL1
  Gene Name: nuclear transcription factor, X-box binding-like 1
  Uniprot ID: Q6ZNB6
  ENST ID: ENST00000464756
  CDS Start-End: 27-2228
gtctgttgggggcgtgcgcagtcgggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaagatagggaaactgaagctctgtgatttgtccatgattctgcaacaggagagtagcaaatcagaaagtactgtgcctgatcttttaactcccagcccaatgtgctcttctactcatgttatttaaatagaagatttttgtaggtgtaccacataggaagagcaaatgaaataaactctttaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaa

SEQ ID NO: 161071 - DNA, 2321 bp, Homo sapiens
  Payload ID: 11462
  Gene Symbol: NUTF2
  Gene Name: nuclear transport factor 2
  Uniprot ID: P61970
  ENST ID: ENST00000219169
  CDS Start-End: 284-667
gggcttgccccggcagcctccctccctggcttagcctcacctcccgcgctgcgggccgtgtctgggcctccgcgcatagcacgccgggaattgtagttttctctcggcgcgctcatgccggaaagggggggcggtgggactgcgtctcccagagtgcagcggggcgggcgaaggaaggcaggggggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtccttttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaattgttttaattagtttactagttggctgggcatcagaagctacccagacccgttgtctctctcatgtttcaccctcccacttctgccccaactctgaatacctgttgcagggagaaactgctgaagcagcactcccagctagcctctcagaagccgtgtagggcagttctctcccactccacagggcgactggtctttggaaagcaggcaggaagagctcaggtctggcctgaagcttctctcactgaagcctgtgcagtcagttctgatacctcctgtgacttctgctctgggtaggttcagggccctagtagcaggagagatgatcctgaatcctgttgaagctggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggatacccttcccctgtcccactacgggtggaggctaaggacctcctcagatcccacagattgcctggtgacattgggcacagggctggatggtgtgctgtttgagaggacagcatgctcaggagatttcagtgggaatgatctctaggctgatgtgtatttggggaagtgggggtggggaagaggtaggtgcctgctgcctcaaaccaccttgtgtaaaatctgcaatacggcttcttccatgtacctgtgcctgaactgtctgcaataaagaagaatttgtaaa

SEQ ID NO: 161072 - DNA, 582 bp, Homo sapiens
  Payload ID: 11462
  Gene Symbol: NUTF2
  Gene Name: nuclear transport factor 2
  ENST ID: ENST00000567105
  CDS Start-End: 260-582
agaccgcgctgggttgccgctgccgctgccgccatcgtgccagcccctcggtcaggaccgtccggatggggccttagggccccgccccgtctagcctggcccggcctgcgcgagccccgcaagctctgcaggctggctagcgggcagaccccagccccacgtcctgctacccacctacgaaggatccggggatgggcagcgccacccggcccgctccagagtcagcatgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacat

SEQ ID NO: 161073 - DNA, 1179 bp, Homo sapiens
  Payload ID: 11462
  Gene Symbol: NUTF2
  Gene Name: nuclear transport factor 2
  Uniprot ID: P61970
  ENST ID: ENST00000568396
  CDS Start-End: 386-769
tatctgggccgtaccgtgctggtggctggtgcaccggcctgcgccatggccaggcctttttctctagtcaggaccgtccggatggggccttagggccccgccccgtctagcctggcccggcctgcgcgagccccgcaagctctgcaggctggctagcgggcagaccccagccccacgtcctgctacccacctacgaaggatccggggatgggcagcgccacccggcccgctccagagtcagcatgggtaagggcgcccgcctgccgcagccggggcttgggcccctcaccctgttcccgaccatagcccggccggggtgtaggtgaacgccccctccttgtctgcccctcggaagtgtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtccttttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaa

SEQ ID NO: 161074 - DNA, 1119 bp, Homo sapiens
  Payload ID: 11462
  Gene Symbol: NUTF2
  Gene Name: nuclear transport factor 2
  Uniprot ID: P61970
  ENST ID: ENST00000569436
  CDS Start-End: 326-709
tcctgtgaggcggcggccgggggtaacgcacagagagccagccgggcgcctatctgggccgtaccgtgctggtggctggtgcaccggcctgcgccatggccaggcctttttctctagtcaggaccgtccggatggggccttagggccccgccccgtctagcctggcccggcctgcgcgagccccgcaagctctgcaggctggctagcgggcagaccccagccccacgtcctgctacccacctacgaaggatccggggatgggcagcgccacccggcccgctccagagtcagcatgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtccttttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaa

SEQ ID NO: 161075 - DNA, 1123 bp, Homo sapiens
  Payload ID: 11463
  Gene Symbol: NXT1
  Gene Name: nuclear transport factor 2-like export factor 1
  Uniprot ID: Q9UKK6
  ENST ID: ENST00000254998
  CDS Start-End: 388-810
ggctgacttcgctgcccgtcacgggaatgcgggagagggcggcgccggggcgctcgcgtctgcgtggagaccggctggccgcgcgcgggaagccgcggaactgcgccggaaagtcccccggctctggggccccggtgacccagagtaagcctccaagaaggaggaggaggagagaaaggcggctcttcccgtgcccctaccagaggcttcggtgggcccaccttgtgacctccgcggccggcccctcagtggaactgcgtcccacgcggggggcgtcccgaccgtgggggccgcggcccgcgctgaccctggacgtcgccgcgcagcccctggttccccaaggcagaggaaataccctggtggagccctccttccatagaaccagagatggcatctgtggatttcaagacctatgtggatcaggcctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctttccctg

SEQ ID NO: 161076 - DNA, 2692 bp, Homo sapiens
  Payload ID: 11464
  Gene Symbol: NXT2
  Gene Name: nuclear transport factor 2-like export factor 2
  Uniprot ID: Q9NPJ8
  ENST ID: ENST00000218004
  CDS Start-End: 103-696
agtcagaggttaacggaaaacggaagctggctggctgagaagaagcttccgttagtcctaccttgaagagaaaagagccagataaagagaaagattaaaagtatgagaaaatacagaagccactggtctcagggagacagagaaggataccaaagaagaagtaactattatgaggggccacacaccagccactcaagccctgcggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtg

SEQ ID NO: 161077 - DNA, 1085 bp, Homo sapiens
  Payload ID: 11464
  Gene Symbol: NXT2
  Gene Name: nuclear transport factor 2-like export factor 2
  Uniprot ID: Q9NPJ8
  ENST ID: ENST00000372103
  CDS Start-End: 223-567
gtgacgaatcacgtcccggctctctgcactgcggggcggggcccacgctttgctgcccgccctgccggccccacccccagcctggttagcagtcgctttctgatcccggaaaggaccctgagctgggaaatagcgagaggcggggatgttggggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatat

SEQ ID NO: 161078 - DNA, 2562 bp, Homo sapiens
  Payload ID: 11464
  Gene Symbol: NXT2
  Gene Name: nuclear transport factor 2-like export factor 2
  Uniprot ID: Q9NPJ8
  ENST ID: ENST00000372106
  CDS Start-End: 132-560
gtggaaaattttgtgcgtttggcgggtttcgctctcttcataagtattgatcattccgcagccctgcggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagat

SEQ ID NO: 161079 - DNA, 937 bp, Homo sapiens
  Payload ID: 11464
  Gene Symbol: NXT2
  Gene Name: nuclear transport factor 2-like export factor 2
  Uniprot ID: Q9NPJ8
  ENST ID: ENST00000372107
  CDS Start-End: 307-651
cccaggcttgtcgttagaaaagtaggggactttcctgttgagtatcatgtttacaaaagcaaagtggcttttaaattttaaactaagtatcaaacaagtagataaggtggatgggagggatcttcaggaactgaagggaagtggaacttaagccctgcggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctat

SEQ ID NO: 161080 - DNA, 3123 bp, Homo sapiens
  Payload ID: 11465
  Gene Symbol: NVL
  Gene Name: nuclear VCP-like
  Uniprot ID: O15381
  ENST ID: ENST00000281701
  CDS Start-End: 261-2831
aatcttccagggtccactgggcaggcctgcaaaataaggcccctagaaactccctgaggttttcaagtcttctccctctcctcggaattttttccccttcattcgcattacttttattctgacggaaacggcgcgggctaggccccaggaggggcgcatttcaggtgcaactggcccggcgatcgcggcgggcaacccctacgaggcccccggttgactaggagctggcggtccgagctgtggcttggaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactata

SEQ ID NO: 161081 - DNA, 2431 bp, Homo sapiens
  Payload ID: 11465
  Gene Symbol: NVL
  Gene Name: nuclear VCP-like
  Uniprot ID: O15381
  ENST ID: ENST00000340871
  CDS Start-End: 256-2259
aagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggctgagtgcagtggcatgatcacagctcactgcagctttgacttctcaggctcaaatgatcctcctgcctcagcctcacaggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggc

SEQ ID NO: 161082 - DNA, 2832 bp, Homo sapiens
  Payload ID: 11465
  Gene Symbol: NVL
  Gene Name: nuclear VCP-like
  Uniprot ID: O15381
  ENST ID: ENST00000391875
  CDS Start-End: 288-2540
ctaggagctggcggtccgagctgtggcttggaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactata

SEQ ID NO: 161083 - DNA, 766 bp, Homo sapiens
  Payload ID: 11465
  Gene Symbol: NVL
  Gene Name: nuclear VCP-like
  ENST ID: ENST00000436927
  CDS Start-End: 254-766
gatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgacgtctcgctctgtcacccaggcttcagtgcactggcacaatcatggcttaccgcagtcttgacgtcccaggcccaagcgatcctcccaccgcagcctcacaggtagctgggattacaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaa

SEQ ID NO: 161084 - DNA, 3003 bp, Homo sapiens
  Payload ID: 11465
  Gene Symbol: NVL
  Gene Name: nuclear VCP-like
  Uniprot ID: O15381
  ENST ID: ENST00000482491
  CDS Start-End: 711-2714
ctacgaggcccccggttgactaggagctggcggtccgagctgtggcttggaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggctgagtgcagtggcatgatcacagctcactgcagctttgacttctcaggctcaaatgatcctcctgcctcagcctcacaggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgact

SEQ ID NO: 161085 - DNA, 2566 bp, Homo sapiens
  Payload ID: 11465
  Gene Symbol: NVL
  Gene Name: nuclear VCP-like
  Uniprot ID: O15381
  ENST ID: ENST00000469075
  CDS Start-End: 12-2309
agaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttc

SEQ ID NO: 161086 - DNA, 577 bp, Homo sapiens
  Payload ID: 11465
  Gene Symbol: NVL
  Gene Name: nuclear VCP-like
  ENST ID: ENST00000461546
  CDS Start-End: 53-577
cccggttgactaggagctggcggtccgagctgtggcttggaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgacgtctcgctctgtcacccaggcttcagtgcactggcacaatcatggcttaccgcagtcttgacgtcccaggcccaagcgatcctcccaccgcagcctcacaggtatactgaaagctattctgatgatgattcaagtatggaagactacccagatccacagtcagcaaatcacatgaacagttccctgctgtctttatatcggaaaggaaatcctgattctgtttcaaatactcctgagatg

SEQ ID NO: 161087 - DNA, 553 bp, Homo sapiens
  Payload ID: 11465
  Gene Symbol: NVL
  Gene Name: nuclear VCP-like
  ENST ID: ENST00000492281
  CDS Start-End: 13-553
aagaccgacgcgatgaagcccagacctgcagggttcgtggataataaactcaagcagcgagtcatccagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaag

SEQ ID NO: 161088 - DNA, 2510 bp, Homo sapiens
  Payload ID: 11465
  Gene Symbol: NVL
  Gene Name: nuclear VCP-like
  Uniprot ID: O15381
  ENST ID: ENST00000469968
  CDS Start-End: 239-2218
cccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactata

SEQ ID NO: 161089 - DNA, 567 bp, Homo sapiens
  Payload ID: 11465
  Gene Symbol: NVL
  Gene Name: nuclear VCP-like
  ENST ID: ENST00000470989
  CDS Start-End: 42-203
aggagctggcggtccgagctgtggcttggaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgaacagcgtctcgctctgtcacccaggcttcagtgcactggcacaatcatggcttaccgcagtcttgacgtcccaggcccaagcgatcctcccaccgcagcctcacaggtatactgaaagctattctgatgatgattcaagtatggaagactacccagatccacaggattcaaaagattcttctcttttggagagtgatatgaaacggaaaggcaagctaaagaataaaggaagcaaaaggaagaaaga

SEQ ID NO: 161090 - DNA, 564 bp, Homo sapiens
  Payload ID: 11465
  Gene Symbol: NVL
  Gene Name: nuclear VCP-like
  ENST ID: ENST00000488718
  CDS Start-End: 12-564
agaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaag

SEQ ID NO: 161091 - DNA, 1310 bp, Homo sapiens
  Payload ID: 11465
  Gene Symbol: NVL
  Gene Name: nuclear VCP-like
  ENST ID: ENST00000467882
  CDS Start-End: 11-901
gaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaaggaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttc

SEQ ID NO: 161092 - DNA, 591 bp, Homo sapiens
  Payload ID: 11465
  Gene Symbol: NVL
  Gene Name: nuclear VCP-like
  ENST ID: ENST00000481213
  CDS Start-End: 1-145
gggcgcagatctctctgctttggtacgagaagcttctatctgtgccctgagacaggaaatggcaagacagaagagtggaaatgaaaaagtagagacggggtttcaccatgttagccaggatggtctcgatctcctgacttcgtgatccgcctgcctcggcctcccaaagtgctgggattacaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactata

SEQ ID NO: 161093 - DNA, 3002 bp, Homo sapiens
  Payload ID: 11466
  Gene Symbol: NABP1
  Gene Name: nucleic acid binding protein 1
  Uniprot ID: Q96AH0
  ENST ID: ENST00000307849
  CDS Start-End: 480-884
agtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagccttttttttttttttttttttttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaaaataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgattttaaaagaaaaaaa

SEQ ID NO: 161094 - DNA, 1914 bp, Homo sapiens
  Payload ID: 11466
  Gene Symbol: NABP1
  Gene Name: nucleic acid binding protein 1
  ENST ID: ENST00000307834
  CDS Start-End: 265-429
gtgttcatcagtcgctgtttgggacgctgggtgtgcggtgttctgtctccgctcccgtttcgctgtcacagcccgttccttcccggagcccgggacaggctgggcgcgcgcccgtgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaa

SEQ ID NO: 161095 - DNA, 843 bp, Homo sapiens
  Payload ID: 11466
  Gene Symbol: NABP1
  Gene Name: nucleic acid binding protein 1
  Uniprot ID: Q96AH0
  ENST ID: ENST00000409510
  CDS Start-End: 343-717
ccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggttt

SEQ ID NO: 161096 - DNA, 11521 bp, Homo sapiens
  Payload ID: 11466
  Gene Symbol: NABP1
  Gene Name: nucleic acid binding protein 1
  Uniprot ID: Q96AH0
  ENST ID: ENST00000410026
  CDS Start-End: 256-630
agtcgctgtttgggacgctgggtgtgcggtgttctgtctccgctcccgtttcgctgtcacagcccgttccttcccggagcccgggacaggctgggcgcgcgcccgtgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaaaataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgattttaaaagaaaaaaatttggaattttagaaaatttaaatgctgtcaggtatggaatgctgggcttccaatcctggcctcattgtctcctcacctgtgatgttggatgagttattacacttgaaatgtctttaagccttaggttccacaagtatgaaaacaagtaagtaacagtatcctttctagacttgtttaagatttccatgtaagtaattataatgacttctgacacataataatgtcgtcttataccccaacagtaggaaaaaaatgcagaattcagtatgaaagtattgttaccctttaacacagtggtccccaacctttttggcaccagagaccagtctcctggaagacagtttttccgtgggatcgggggatggttttgggatgaaactgttccacctcaggtcatcagtcattagttagattctcataaggagcgtgcaacctcaatcccttgcatactcatttcacaatagggttcatgctcctatgagaatctaatgccaccactcatctgacaggaggtggagctcaggcagtaagtctccctcgcccgccactcacctgctgggcgttcctgttcctagcaggccagaattgatactgatctaggggttggggacccctgcttaacatgttgagattaaatggagaaagacttaagcttttacttttgtgattgacacttgcttcaataatgtaaccttgttctgtgtttttatcatttattaacaaatttcttttttcttaagggaagcctccaaaatcaaagaaaagtgagttacaatccataatgaatatttgccttaccagcctactggaacacattcatcaagaacttaagaggaagaaagttttctgccttcctccttcctagtgctctcagctatcaactttgaaataagtttaaacaacacctactgaaaacaaaaaccacttagtataaaaatatcccccaccagaattgggtcccccatatcatttctacaaaacagttctggagtggatcaaagtctcatcagatcagcttgccccttcttgtttgggcaggttctaggagaagctgctgtaatacaaaaactgaaagatgaaatcgtaaagctagataatgataatgatatttagtggggaaggctacagtatgttttcccataggcatttaaacactcactttttccaacgctttatactttgtccctatagcctttgtaattttaactttgatgacagtttaacttaggataacctgaatatgggtattactgttagtcatttgtatttttatcatttaacattttaaatgaatgtttaatttgctgggttgagtaatgccaagggaatgatgctaaaaacaaatagatgtgaggttagtaaaagattaaagttacaatttatgatacgagaacttcttaactataggaaagtaggtaaatgaccctaaaaggttttctcagaaggtaaaagttttacatcagtctgaagacatataactctaacatttcagtttagttactgaaatgactttttctggtgtcattgagatactggctgtttgttccaagccattttaggctgagaatgactcttaaggtcttctaatgcatttcagagggttctagaaacaacaaactgaacatgatatgaaactaacaacatagaatgccccccaaacaaattcctctaacctcactgagtttacttgccctattactattttttttttttaagatcttctgtctcttgtttttgttttatcccttacctgatgaaagtgaacatttctagtggagaaagaagatcacagttctctaatatgggcattaagagaggggtacagctagaggggaggtgaaaacctgcctccactggggtgaaaaacagtgtgctgaggtttcagccagtgattacactgggtaatcaaccagtcccatgtttcacaaaggagttgtaatgattaacagttcaggtatgcttctgaggaaatctaattgagacctttggaaaatagcattgttatgaatggtgtggtgttacgccctgagggaaaagctagaaaaacattttacttttcaagtgtatttaaattacatccaaatgtttcagtgtgctttactggagactgcctgagtttggaattcaaatattgtaaccaaattactccaggtttctgaactaaaatgatctattgatgtttctcaaagtatagatcacagagtaagaaaagaggaaatcaagtctggtttatgacaaacttttttccatgttaacattggacccaaagatgttactaagagctttttactactgtgagagaaccagcgtgatgtgaagacaacgaacattttaagaagtttgactagtagacatttcgtttaagtcttttggagggtcttggttgacaacccacaattttattgtggctccccaggctttgagaacgtgtgggcttggatgatcattgttgacctataaaagagcacaggtctcttgagagtttattgacacactactgatcagacccccacaatatgtctcaacctctgttgaagggctagtgatgtttaaaaaaacctgttatttccaatcagaaattgaagttatgtctcttactccatcaaaatttatgcttttcagcattgggtaagtctagtttcttggtttgtatattaaatgcatattgagtaaaattcttagtgatttagaaaccatctacatgaggcttcccaggaacttgttaaaagtacaggttgcacctctgcattactagaataacatcagtgtacatttgggagatctgcatttgaaaccctgaggttgtctgcctcctgcccttgagatcttcccttgtattgaaattatatatatatatatatatatattttttttttttcccctcagtttcttttacctttgtgaggctaatatatgctgacgtgttggattgtaaaacaaaaaattgtgcttaaaagaatgtccctccagagggcagaattgttgggtaaagcatatagcgcagagcagaataagaggttcagtatggcctctggatgagggtattgcaaattttgaattaggctcaaataaaatgatttaaattatatatcaattcgaggatcagatattaattgggaggtcacatgactttccttgagcctatctagataaaagtaaaatgctttttttcctacgtttttgaaaatttagagtttattgttgctcatctcagcaaattaatgttaccagcatcttctgccttcctcctgtccctcaattccctactttactaaaagaaggctggccaaattgaaaagtagttgagttggagacttgataaatacttttgaaaatacttagagaaaccacccttcatcttccacgtaaagatctcagttctgtacagagaggcaactacaatgagtattttctgcaagtaacatggaaatcatgatttgattgccatgtgtttctaatgttcagtattaaatgtttatagccctcgtaggaaacaaacttctgacctaagttgctggactacttgaatagaaaggtagtcagcacaactagtgccatctactgggtcattgctgcatagtttctgtctgtttagaaatctggcttagtttaacacgtgggggaaatggttctgttccaatgaatagcgatttttgcctgatagtggtgttaagtatgatatggaaaatccttaaggggcagttgggccatttgtttagtttatgaacaatcaacactgacattaaatttcagttaagtagatgaaaccctgaactgcccctaaagctatagaaaatatgggaaaggttgccaagttttgtattctcatcacatttgtcaatattgttggtgagaagtgtaaactgttaaaaatgccttttggtgagtggtggtttggtaaaaacaattgaagtagaacacgacactgcccttagaaatttcattcctttacccaatggtatttggtaaaatcctggccaaatgactgctgctgttgtaattatgtgagctttgcagaacataacctattttaaatgccagaatgtgcttccatgaagaagaacatggttttgggctgaggagatcttggtttgagtcctggatctatttactggctccaggaccatgaacctcgttataaaatgatagtggggctatgtactcatagtgttaggaggactatgtgagctaatgtatgcaaaacatctgctccatatctaagggtcaacaaatgttaagccctttctccatcagcattggaaataagttaaaatactgttcatttctccatgccattattagaaaacaatcttctataatttaaaatctgaaatattaagcaatttatgtgaattattacaattatgttcttttttaaacagtcaaaccaagtttttcctgtcttgtctgggcacagacaagcacttatgctgacggtttaccgtgacagcatgtagggttgggtcttcattacaaagatctgcccactagctgagtacactggtgtttttccattcacctctgcccagcaggacaagatgatgaaagtacagagaacttgtgggtccaggtttgtgtcagaaaggaggttagtggcttgcttagggccaggcagagggcacattggaaggaattctctgttcccggtgacagcccttggaattgctgtgcacccagagttgcggagtaatttattggcttctgataactatagtattggataacttcccaacattttattaaaaattttaaacatataggcatgttgaaagaatttatactcaccacctagattttgccactatcacatatctgtgcatcctattaatacatttttaattattatttttttgagacagagtttcttttactcaggctggattgcaatggtgcaatctcagctcactgcaacctctgcctccaagattgaggcgattctcccacctcaggctcctgaatagctgggactacagaggggagccaccatgcccggttaatttttgtatttttggtaaagaaggggtttcatcatgttgccccaggctggccttgaactcctgggctcaagtgatcctctggcctcagcctcccaaagtgctaggattacaggcatgagtcaccgtgcccagccagccattaatgcatttttaatatatttttagtcaattgcagacatcgtacaattttccctaaacgttgcaacatgcctattcattacagttcagtatttttcaggattttttttttttgtaaaatttacaaagaaatgtggaaatcttagttgtgcattagttgagttttaacaaatacctaggctttatcgcaacctctatcaagatacagaacattgctgtcattctagaagcctctgtaatgtgccttccccagtcaatctctttttccatggccccagcagccatcattctttcaatactttaaaaaacattcttatctgaagggaaatttcatatgtgccaaagtcatctctagatttctccaagtcttaaccatgccagagtacagccaaacctagcccttcatgcatctcaaataaagttctaagatcttggtattttattcttccctgtttcaacttagctccaactctttttttcttttttccatcaagatttaaacctgtcatccttgacatttggggcagaaactgctgaaatgaaggaggacttgccatcaaagaactggctgaaaggagttagcacaccactcctctgccctgaacagttctaagcaagaggaggagcctgtggcagggcgtgatatgaagtcctcagagatagagtgccaagagtagagggagtatcctggaacttcagtgtttgcaggtcagttgctcagttcttcagaagatattgattcttaggctctaattttcttaaggtatgagctgaactgaagtgctctctcctccttaggattttgtactccaaggttggcattcagaatccgcatagccagagagtgtaagttacttgtcaagtaaagacaccccgccccccgctacaaccccccaccctgagtctacagggaaatattcctgagtgaaacagactaaaaaaatatagtcatgtgttctttcccagtccatgtgcacgtgcacgtatatacacgaacacatgacacattatcactgccatcagaggtgtttctgcattgaactccacatatctgagtcacatgcatatcaggtctttgcttttctttctcatcaattgtttaaggattctctccttccacttctttaatgggctgcctatactttgttgagcactaactatatgccaagtactatgctagtgagttacctatgaaagaccctgagagggaggttttgttatccccatgggaaggattgagtagtttgcatgagatcacacaactaggcggtgactgagtccaacacaccaaagcctatactattacagttgagcaatagtgaaacattgaggctgctgctgacagtggatggtgcttcatagaggatatagaattggagttagttttgaaagggagtgtatgcagaggggaagatggagaacaaaatatggaatttgactaatttacatttttacctgagattagtcatactttaaatgtcaacttattacaaacccaattagtcaaatttaagtctacagaagtggtatcagatcaacagggaaattatggactcttgggtattgggataactggatactctccctaaccaccacacaaacagtaaaaaaccatgggtgaattctattaagaatggagaaaattttccaaaaatggctcaaagtccagaagcattaaaggaaagattgatcaatttgactacatttacatgttaaaaaataaaatgacaactgggaaaaacatttgtaacatcacaaagggctaatattcctaacataaaaagaacttgtataaatagagaagacaaaacacactatggaaaagtgggcaaaagatatggacagttcacagaaaaaaagttcaaatggcccttaagtatataaaaagatgctcaacttcactcataatgaaagatgtaaattaaaataccaccaagataacattcttcacttttagattggaaaaaatatgaaagtttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaatgaaagtttgaaaacacacttgcttggccaggtgtggtggctcatgcctgtaatcccagcgctttgagaggccaaggtgggtggatcacctgaggtcaggcattcaagaccagcctggccaacatggtgaaaccccgtctctactaaaaatacaaaaatttactgggcataatggtgcgcacctgtaatcccagctacttgggaggctgaggcaggagaattgcttgaacctgggaggtggaggttgcagtgagccgagattgcacctctgcactccaacctgggcgacgagagtgtaactctgtctcaaaaaagaaaatattctcttggtaacactattggaataggaacattcactgatggaggaaatgcaaaactgtataatctctgttataggggaatttggcaattttacatttaaatttgccttgtgacccagcaatcctgctatattattcctttcatattgctataaaaaaatctgaggctgggtaatttataaagaaaggaggtattttttttcatggttcttcaggctgtatacaagcagggctgttagcatctgctcagcttctgatgaggcccaggaagcttttggtcttggtggaagagaagaggagccagcatattacatgacgagaggaagcaagagagataccaggctcttttaagcaaccagttctcatgtgaacgcattgctactgagaaagtgccaaaccattcacgagggatccactacctagacccaaacacctccccctaggccccgtctccaacagcggggatcatatttcaacatgagacttcgaggagacaaatatccaaaccatatcgcccacgtttaggaatgtctctccatggtagatgatttgcaaatagacggtggtatacccattccatggaagcagggaaatatgtttgcacgtctttggttagtcctcttcttttctactgacagtgggcttgtccatgtgtcctgcatgatcaaaatgacaatagcaaacttgatggccacagaagattgaaaagtgcttgggcattgagcttgctctctcttgaagtgcttggagccctgagactgccatgagaccacataaatgatcactagctagcctgctggaggatgagaggtcacttgagaaaccttggctcacagcctgcttacaccagacacatggatgagtctgtcttagactatccagctccagctgagttgccagctgacttcagtcacatgagtgagaacaacagaaggacagcactgagctctgccaaaattgctgacctacagaatcttgagctaatgaatgattgtagctttatgccattaagttctgaggcagtgtgctatacatagcaaaagctaactgatacaaaactaaagatacaatggcacaaacatgaaaagacatgttcaccgaagcattgcctataatagttaaagactggaaacgactcagatgtccaccaactcaggagtggttgaacctactacagtgcattcaccccgtggaatactaagcagctccaacaggggtaggaaatttgtatactttcataaaatgatctttaggatatattgttaagtgaaaaaaacaaggtgtagaatagttaatagagtatgctacctcttatttaataaagggagaatat

SEQ ID NO: 161097 - DNA, 2015 bp, Homo sapiens
  Payload ID: 11466
  Gene Symbol: NABP1
  Gene Name: nucleic acid binding protein 1
  Uniprot ID: Q96AH0
  ENST ID: ENST00000451500
  CDS Start-End: 469-873
gggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagccttttttttttttttttttttttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagatccacagtgatcgatcaaaagagggactgaatgggagtgggtgaatggatcggtgcaaatccattaccactgctggagaaaccaccctggaaccctaaacatggttcactctcatgttatttttcctttgatcagcttttgtggaaaaacaggacagagatgtttttgtgtccttgatttttgatgtgatttttttttcagcactaaagaagaatttaaatacaaaatagaatgttatatatcttgtagacagtcaaatatttgatgttttatgggacataatcatttgggaagtttttgttgtaaatgaagagttagtttgttgctattaatttgtttgacacataagttcattcctaaaagttagagatgttacataaagaagggttgaggactttatttcagaagtcatttaattttttctttattttctttcagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagat

SEQ ID NO: 161098 - DNA, 915 bp, Homo sapiens
  Payload ID: 11466
  Gene Symbol: NABP1
  Gene Name: nucleic acid binding protein 1
  ENST ID: ENST00000435931
  CDS Start-End: 1-506
gacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcagaagtgccaaatttcagtgaacccaacccagattatcgaggacagcagaacaaaggggcacagagtgaacagaagaataattccatgaatagtaatatgggtacaggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataa

SEQ ID NO: 161099 - DNA, 1878 bp, Homo sapiens
  Payload ID: 11466
  Gene Symbol: NABP1
  Gene Name: nucleic acid binding protein 1
  Uniprot ID: Q96AH0
  ENST ID: ENST00000425611
  CDS Start-End: 84-698
cgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaa

SEQ ID NO: 161100 - DNA, 1417 bp, Homo sapiens
  Payload ID: 11467
  Gene Symbol: NABP2
  Gene Name: nucleic acid binding protein 2
  Uniprot ID: Q9BQ15
  ENST ID: ENST00000267023
  CDS Start-End: 141-776
aacttccgggaatgtccgcactcccgcgttccacggggcagcatccggcggcagcggagcctgtggctccccctgcgggctgctcagcggcgtgcacagtcctgccggctggcttggtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaagaaagaaatggcagttaccatctgtttcttctgtgtgagacatgggagtctaactgaagtctctccttcctaataaatgttaccactcta

SEQ ID NO: 161101 - DNA, 1411 bp, Homo sapiens
  Payload ID: 11467
  Gene Symbol: NABP2
  Gene Name: nucleic acid binding protein 2
  Uniprot ID: Q9BQ15
  ENST ID: ENST00000341463
  CDS Start-End: 145-780
gggctgctcagcggcgtgcacagtcctgccggctggcttgggtgggtggtgggctgcgggtaggggaggggatggaccgagtcccggcttgtcgggatgagggttccggaagatctggccatggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaagaaagaaatggcagttaccatctgtttcttctgtgtgagacatgggagtctaactgaagtctctccttcctaataaatgt

SEQ ID NO: 161102 - DNA, 1775 bp, Homo sapiens
  Payload ID: 11467
  Gene Symbol: NABP2
  Gene Name: nucleic acid binding protein 2
  Uniprot ID: Q9BQ15
  ENST ID: ENST00000380198
  CDS Start-End: 499-1134
ggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaagaaagaaatggcagttaccatctgtttcttctgtgtgagacatgggagtctaactgaagtctctccttcctaataaatgttaccactcta

SEQ ID NO: 161103 - DNA, 663 bp, Homo sapiens
  Payload ID: 11467
  Gene Symbol: NABP2
  Gene Name: nucleic acid binding protein 2
  ENST ID: ENST00000399713
  CDS Start-End: 209-663
agccaggagctgcctacgaggagggacgaaggctggccaggcctccactctagacaggaagtctagtctagagtctatatggtcccagccaggactatgtagccatttaggagggagaactctatgttcttcccggcaaaaacgtgtgggcctggccggccacgcttcgctttggaggggtgcagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgg

SEQ ID NO: 161104 - DNA, 770 bp, Homo sapiens
  Payload ID: 11467
  Gene Symbol: NABP2
  Gene Name: nucleic acid binding protein 2
  ENST ID: ENST00000447747
  CDS Start-End: 338-770
agccaggagctgcctacgaggagggacgaaggctggccaggcctccactctagacaggaagtctagtctagagtctatatggtcccagccaggactatgtagccatttaggagggagaactctatgttcttcccggcaaaaacgtgtgggcctggccggccacgcttcgctttggaggggtgcaggttccatttcttccaagaagggtgagcctgccttttgtctctggtgtaaatgccacttttcccagagaccttgaccaagctgggtagtgcattaaagatgagaaccccaaatcaggaacaaagataacgtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctc

SEQ ID NO: 161105 - DNA, 2158 bp, Homo sapiens
  Payload ID: 11468
  Gene Symbol: NUCB1
  Gene Name: nucleobindin 1
  Uniprot ID: Q02818
  ENST ID: ENST00000407032
  CDS Start-End: 65-1450
cgcaccggaggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 161106 - DNA, 2668 bp, Homo sapiens
  Payload ID: 11468
  Gene Symbol: NUCB1
  Gene Name: nucleobindin 1
  Uniprot ID: Q02818
  ENST ID: ENST00000405315
  CDS Start-End: 335-1720
gcggaagttatttttcccccggccggcagggagttgtagttatctttgaaagccttctctctcttttggcataggcgggaaatgtggcgtcaagaggctgggattccgagaaagaagcgaggctttcacgaaaatgcgagcggcttcggcaaggggcggggccgctggacgtggatgaaagctacagagccagcgtggaccaatcagacctctttggggcggggcctctgtggataagtgggcgtggtctaggggggaagtcaccaagaacgcaccggaggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaatgcatggctccatgcctgtgtatctggactggtccctccaaaacgctattgccacgtcacctgccggagtcctcatctttgaagactggattcaagcatca

SEQ ID NO: 161107 - DNA, 864 bp, Homo sapiens
  Payload ID: 11468
  Gene Symbol: NUCB1
  Gene Name: nucleobindin 1
  ENST ID: ENST00000452087
  CDS Start-End: 62-864
accggaggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacagggaccttacacatcccgtcctcggtcccctgagataccttgctatcctcttcccttcagatatcaacagtgatggtgt

SEQ ID NO: 161108 - DNA, 884 bp, Homo sapiens
  Payload ID: 11468
  Gene Symbol: NUCB1
  Gene Name: nucleobindin 1
  ENST ID: ENST00000424608
  CDS Start-End: 1-884
tgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggag

SEQ ID NO: 161109 - DNA, 563 bp, Homo sapiens
  Payload ID: 11468
  Gene Symbol: NUCB1
  Gene Name: nucleobindin 1
  ENST ID: ENST00000451312
  CDS Start-End: 232-563
gagcgtgttgggagccaggacccctgggtctgagggcccagactcctgtgtcggaggaagggaaggccggaggcctggaatcctggggcctgggtaacaaaatgcttgtgtcttgattcttggaagtgggggcggcgctgggggcccgaactcctggttccaggggaggaagaggcttgggacagacattatgcattatccagccctccatcccccacagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggct

SEQ ID NO: 161110 - DNA, 551 bp, Homo sapiens
  Payload ID: 11468
  Gene Symbol: NUCB1
  Gene Name: nucleobindin 1
  ENST ID: ENST00000443560
  CDS Start-End: 30-257
ctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgtgagtggccctgccctgctatccagccaggtgtttgcagtggtactacagctcctgcagaccccggtgcccgtagggcggatgctccagtgacttcctggccctacagttgtagcttgttttttgcccaccattcctcccagcagcaggggtttgacttggtgaaaaactggaggtccctgactctgaggacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggct

SEQ ID NO: 161111 - DNA, 673 bp, Homo sapiens
  Payload ID: 11468
  Gene Symbol: NUCB1
  Gene Name: nucleobindin 1
  ENST ID: ENST00000411700
  CDS Start-End: 301-673
gaggtgagaggccagggttcccatactcttgggtcctagggaggatgggggccagagggctggaaaactgggtcccggaggaggatgcactgggtgccagtactttaggtcctgggaaaagaggaggctgggaccctggactcttgggtctgggggaggaggcggccgagatcccggattcctgagtgtgagagaggagcgtgttgggagccaggacccctgggtctgagggcccagactcctgtgtcggaggaagggaaggccggaggcctggaatcctggggcctggaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatc

SEQ ID NO: 161112 - DNA, 1905 bp, Homo sapiens
  Payload ID: 11469
  Gene Symbol: NUCB2
  Gene Name: nucleobindin 2
  ENST ID: ENST00000323688
  CDS Start-End: 244-1506
agcggagcggtgggccgggggctggaggacaggtttgtgcgctggacgcaagcaccaggcgcagcctcgctcgccgagacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacgtgtgtaattttgtttgattatttatttaggaaaataaattattttatcaattgaaatccacatttattacaaatataatttcaaatcattaagatgttatgttattttttgtgtattttttgtggtattagagcaatttagattatagaaaaatgaaaatgcctccaaaagttttatgtagcagcaaattttaagtgctgtatcatttgtataatttgataaccatatttatggtaaaatgatttatttcaactttatttgtaattctttctaattatattaatcttaccagagaatatgttttttaaaattgtgatctatgattagctaagcatattttttaaaacaagtatatttgtatatgaaggaacatttagaataaaggaagatacttttaaaataagaa

SEQ ID NO: 161113 - DNA, 1279 bp, Homo sapiens
  Payload ID: 11469
  Gene Symbol: NUCB2
  Gene Name: nucleobindin 2
  ENST ID: ENST00000458064
  CDS Start-End: 3-1175
agatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagca

SEQ ID NO: 161114 - DNA, 530 bp, Homo sapiens
  Payload ID: 11469
  Gene Symbol: NUCB2
  Gene Name: nucleobindin 2
  ENST ID: ENST00000528644
  CDS Start-End: 430-530
ctctcccgaggaatgctgagcaggctctggacgcctctccgtgcacaccccagacctggggaggggagctctccggacaccccagctggccgcccctcgggccctgagtccgaagacccgctaaacagggcccgggcactgaagtaccctattgttctcatcccctctcccgggaccccgcaccctcctccatctaggctgaggttcccagatttgtgtcttggcccctggcggcgccgagattactttgtgattggaagactgaaaggaacagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagt

SEQ ID NO: 161115 - DNA, 463 bp, Homo sapiens
  Payload ID: 11469
  Gene Symbol: NUCB2
  Gene Name: nucleobindin 2
  ENST ID: ENST00000530964
  CDS Start-End: 362-463
aaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacctctgaaatctgtaagctgtgataaccactcatagaagcttctataatttgccatggcagagatataagtctgactattaactacagaaggaaataatcttcatgtccgtatctctcttatgaaagaagagggtgataaaggaaaggagaaggccattcttactgacctgatagtggaagaaaagtagatgaggtggaggaccatcctgctacagtattgctttctcttgattacatgtttacttactgctcttgaagctgtgcctattgacatagacaagacaaaagta

SEQ ID NO: 161116 - DNA, 937 bp, Homo sapiens
  Payload ID: 11469
  Gene Symbol: NUCB2
  Gene Name: nucleobindin 2
  ENST ID: ENST00000529313
  CDS Start-End: 352-937
tcccagcgcgagccggaggcgctgggttccctctgctccactcgcagctgggcacccgagctttcttcggggtcgaggagggtggctggctcttggcggggagcaggagaggaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacgtccgtatctctcttatgaaagaagagggtgataaaggaaaggagaaggccattcttactgacctgatagtggaagaaaagtagatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattga

SEQ ID NO: 161117 - DNA, 317 bp, Homo sapiens
  Payload ID: 11469
  Gene Symbol: NUCB2
  Gene Name: nucleobindin 2
  ENST ID: ENST00000527735
  CDS Start-End: 1-220
agaagaaaggcttagaatgagggaacatgtaatgaatgaggttgatactaacaaagacagattggtgactctggaggagtttttgaaagccacagaaaaaaaagaattcttggagccagatagctgggaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatatttt

SEQ ID NO: 161118 - DNA, 498 bp, Homo sapiens
  Payload ID: 11469
  Gene Symbol: NUCB2
  Gene Name: nucleobindin 2
  ENST ID: ENST00000533926
  CDS Start-End: 229-498
actcgcagctgggcacccgagctttcttcggggtcgaggagggtggctggctcttggcggggagcaggagaggaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaa

SEQ ID NO: 161119 - DNA, 1839 bp, Homo sapiens
  Payload ID: 11469
  Gene Symbol: NUCB2
  Gene Name: nucleobindin 2
  ENST ID: ENST00000533773
  CDS Start-End: 349-1365
aaaaaaactaatcggcaggatgaaacttcgtaaacagcctgtggctccaaaagcttctggaaggctcaagctacccatgtgcatctttgagcctcagtttccccatctttaaaatgaggggtttggaatagatgtctgttctctggggcaggatgcagaggaaagagctgtctgcgaatgggcaagagagaagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagtctccttccatctgaaacaatcaagaggacagactattatgttgtacaatgtcccttgaataccacagaagagatgctcagtgtatcctattagaaggcacatgttgacgatccccataactgacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcat

SEQ ID NO: 161120 - DNA, 1837 bp, Homo sapiens
  Payload ID: 11469
  Gene Symbol: NUCB2
  Gene Name: nucleobindin 2
  ENST ID: ENST00000530527
  CDS Start-End: 1242-1837
atattattgcaagcctttgcacatctctttgtatcatccccctatgacatcatgtgttaatctcatctcaggactgcaacccaagattgcagtgagtgggaagatacaatttttacagcatcaccaaaaaggataaggttatttggagatggggacttgctatgttgctcaggctggtttcgaactcttggcctcaagtgattttcctgccttggcctctcaaaacacaggaatgcaggtcaaacacattttgagtttctcagctgagccaaaggaaatcaagaaatctcctggaatcaaggaaatcaaggaatcaattacttacaccaagctgagcaagagacaacatgaaggcagaggtagcagtaatcagacaggatttccaagacagggtctcactctgtggcacaatgatcatggttcactgcagcctcggccttctgagctcaagtgatcctcccgcctctgcctccgcctcctgagtagctgggactacagatgtgcgacacagcacctggcaaatttttaagtattttcttcagactgaaacatcattgtgttaaagataaaaaagtaaaaaatattcttgtagagataggatctcactgttgtccagattggtctcaaatttttgagctcaagccatcctcctgccttggcctcccaaagtgctggcattacagggtgaaaaaaactaatcggcaggatgaaacttcgtaaacagcctgtggctccaaaagcttctggaaggctcaagctacccatgtgcatctttgagcctcagtttccccatctttaaaatgaggggtttggaatagatgtctgttctctggggcaggatgcagaggaaagagctgtctgcgaatgggcaagagagaagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacgtccgtatctctcttatgaaagaagagggtgataaaggaaaggagaaggccattcttactgacctgatagtggaagaaaaatttctccttaaaaatatcagtcttggccgggcacggtggctcaggcctgtaatcccagcactttgggaggctgaggcgggcagatcacctgaggtcaggagttcaagaccagcctggccaacatgatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaa

SEQ ID NO: 161121 - DNA, 534 bp, Homo sapiens
  Payload ID: 11469
  Gene Symbol: NUCB2
  Gene Name: nucleobindin 2
  ENST ID: ENST00000533738
  CDS Start-End: 328-534
agcggagcggtgggccgggggctggaggacaggtttgtgcgctggacgcaagcaccaggcgcagcctcgctcgccgagacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacgtccgtatctctcttatgaaagaagagggtgataaaggaaaggagaaggccattcttactgacctgatagtggaagaaaagtagatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaa

SEQ ID NO: 161122 - DNA, 701 bp, Homo sapiens
  Payload ID: 11469
  Gene Symbol: NUCB2
  Gene Name: nucleobindin 2
  ENST ID: ENST00000527580
  CDS Start-End: 1-595
aacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcata

SEQ ID NO: 161123 - DNA, 514 bp, Homo sapiens
  Payload ID: 11469
  Gene Symbol: NUCB2
  Gene Name: nucleobindin 2
  ENST ID: ENST00000531172
  CDS Start-End: 397-514
ggggcagagcggagcggtgggccgggggctggaggacaggtttgtgcgctggacgcaagcaccaggcgcagcctcgctcgccgagacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatttctccttaaaaatatcagtcttggccgggcacggtggctcaggcctgtaatcccagcactttgggaggctgaggcgggcagatcacctgaggtcaggagttcaagaccagcctggccaacatgatgaggtggaggaccatcctgctacagtattgctttctcttgattacatgtttacttactgctcttgaagctgtgcctattgacatagacaagacaaaagtacaaaatattcaccctg

SEQ ID NO: 161124 - DNA, 496 bp, Homo sapiens
  Payload ID: 11469
  Gene Symbol: NUCB2
  Gene Name: nucleobindin 2
  ENST ID: ENST00000526120
  CDS Start-End: 290-496
agtttctcagctgagccaaaggaaatcaagaaatctcctggaatcaaggaaatcaaggaatcaattacttacaccaagctgagcaagagacaacatgaaggcagaggtagcagtaatcagacaggatttccaagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaa

SEQ ID NO: 161125 - DNA, 2274 bp, Homo sapiens
  Payload ID: 11469
  Gene Symbol: NUCB2
  Gene Name: nucleobindin 2
  ENST ID: ENST00000529010
  CDS Start-End: 220-1482
gaggacaggtttgtgcgctggacgcaagcaccaggcgcagcctcgctcgccgagacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaattctggaaaggccacagtatttccctgtgtttcctggtaacgtttttctagttttggcaacctcaactgctagaaattcttcacctgaatcacttttgctaccacttcaggtcatttttcattcttttttattttgctctatactttatcatttaagattaggttatgttacatataacagaaaaaacaaagataacagtggtttaaactaaataggagtttttcttcttacataagtctagaagtaggtggtgtccaggttcctatctttctgctctgctatcctcagtgcatgatttttatcctcagattacctcactctcactgttcaagtttgctcctggag

SEQ ID NO: 161126 - DNA, 1369 bp, Homo sapiens
  Payload ID: 11469
  Gene Symbol: NUCB2
  Gene Name: nucleobindin 2
  ENST ID: ENST00000622082
  CDS Start-End: 3-1265
agatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagca

SEQ ID NO: 161127 - DNA, 3727 bp, Homo sapiens
  Payload ID: 11470
  Gene Symbol: NOLC1
  Gene Name: nucleolar and coiled-body phosphoprotein 1
  ENST ID: ENST00000370007
  CDS Start-End: 1-2126
cggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaaggtctggaccataacttctgtcagggcagagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 161128 - DNA, 3967 bp, Homo sapiens
  Payload ID: 11470
  Gene Symbol: NOLC1
  Gene Name: nucleolar and coiled-body phosphoprotein 1
  Uniprot ID: Q14978
  ENST ID: ENST00000405356
  CDS Start-End: 236-2365
gcggccggtgggctccgcccttaaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgggttcctgagtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaaggtctggaccataacttctgtcagggcagagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtgt

SEQ ID NO: 161129 - DNA, 2288 bp, Homo sapiens
  Payload ID: 11470
  Gene Symbol: NOLC1
  Gene Name: nucleolar and coiled-body phosphoprotein 1
  ENST ID: ENST00000464969
  CDS Start-End: 17-238
gcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaatcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattg

SEQ ID NO: 161130 - DNA, 777 bp, Homo sapiens
  Payload ID: 11470
  Gene Symbol: NOLC1
  Gene Name: nucleolar and coiled-body phosphoprotein 1
  ENST ID: ENST00000461421
  CDS Start-End: 3-777
ggatggcggacgccggcattcgccgcgtggttcccagcgacctgtatcccctcgtgctcggcttcctgcgcgataaccaactctcagaggtggccaataagttcgccaaagcgacaggagctaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgactctgacagctctgaggatgatgaagctccttctaagccagctggtaccaccaagaattcttcaaataagccagctgtcaccaccaagtcacctgcagtgaagccag

SEQ ID NO: 161131 - DNA, 844 bp, Homo sapiens
  Payload ID: 11470
  Gene Symbol: NOLC1
  Gene Name: nucleolar and coiled-body phosphoprotein 1
  ENST ID: ENST00000476468
  CDS Start-End: 1-844
ggcggacgccggcattcgccgcgtggttcccagcgacctgtatcccctcgtgctcggcttcctgcgcgataaccaactctcagaggtggccaataagttcgccaaagcgacaggagctgtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaa

SEQ ID NO: 161132 - DNA, 3932 bp, Homo sapiens
  Payload ID: 11470
  Gene Symbol: NOLC1
  Gene Name: nucleolar and coiled-body phosphoprotein 1
  Uniprot ID: Q14978
  ENST ID: ENST00000605788
  CDS Start-End: 236-2335
gcggccggtgggctccgcccttaaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgggttcctgagtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataa

SEQ ID NO: 161133 - DNA, 3217 bp, Homo sapiens
  Payload ID: 11470
  Gene Symbol: NOLC1
  Gene Name: nucleolar and coiled-body phosphoprotein 1
  ENST ID: ENST00000603946
  CDS Start-End: 8-148
ctggaggatggcggacgccggcattcgccgcgtggttcccagcgacctgtatcccctcgtgctcggcttcctgcgcgataaccaactctcagaggtggccaataagttcgccaaagcgacaggagctctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataa

SEQ ID NO: 161134 - DNA, 2441 bp, Homo sapiens
  Payload ID: 11470
  Gene Symbol: NOLC1
  Gene Name: nucleolar and coiled-body phosphoprotein 1
  Uniprot ID: Q14978
  ENST ID: ENST00000488254
  CDS Start-End: 8-2110
ctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattga

SEQ ID NO: 161135 - DNA, 2409 bp, Homo sapiens
  Payload ID: 11471
  Gene Symbol: NUSAP1
  Gene Name: nucleolar and spindle associated protein 1
  Uniprot ID: Q9BXS6
  ENST ID: ENST00000260359
  CDS Start-End: 265-1545
gcgttacaggccctttggcgcctgcgtattcgtgaagtgtgaaaaaagcgcgcctctgttgggacgggaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 161136 - DNA, 2274 bp, Homo sapiens
  Payload ID: 11471
  Gene Symbol: NUSAP1
  Gene Name: nucleolar and spindle associated protein 1
  Uniprot ID: Q9BXS6
  ENST ID: ENST00000414849
  CDS Start-End: 88-1410
aaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 161137 - DNA, 1301 bp, Homo sapiens
  Payload ID: 11471
  Gene Symbol: NUSAP1
  Gene Name: nucleolar and spindle associated protein 1
  Uniprot ID: Q9BXS6
  ENST ID: ENST00000450592
  CDS Start-End: 88-1224
aaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcat

SEQ ID NO: 161138 - DNA, 580 bp, Homo sapiens
  Payload ID: 11471
  Gene Symbol: NUSAP1
  Gene Name: nucleolar and spindle associated protein 1
  ENST ID: ENST00000559046
  CDS Start-End: 104-334
aaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcagtttcactcttgctgcccaggctggagtgcaatgacacgatctcggctcaccgcaacctccacctcctgagttaaagcgattctcctgcctcagcctcctgagtagctgggattacaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttct

SEQ ID NO: 161139 - DNA, 1629 bp, Homo sapiens
  Payload ID: 11471
  Gene Symbol: NUSAP1
  Gene Name: nucleolar and spindle associated protein 1
  Uniprot ID: Q9BXS6
  ENST ID: ENST00000559596
  CDS Start-End: 88-1413
aaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagt

SEQ ID NO: 161140 - DNA, 416 bp, Homo sapiens
  Payload ID: 11471
  Gene Symbol: NUSAP1
  Gene Name: nucleolar and spindle associated protein 1
  ENST ID: ENST00000557840
  CDS Start-End: 1-206
tgttaaaagccttgaaaggctacattaaacatgaggcaagaaaaggaaatgagaatcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagac

SEQ ID NO: 161141 - DNA, 708 bp, Homo sapiens
  Payload ID: 11471
  Gene Symbol: NUSAP1
  Gene Name: nucleolar and spindle associated protein 1
  ENST ID: ENST00000560898
  CDS Start-End: 1-435
caagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttcaagtgattcttctgcctcagcctcccgagtagctgggactacaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctggaaagctaaaaccatgggggcaatctaaagaaaataattatctaaatcaacatgtcaacagaattaacttctacaag

SEQ ID NO: 161142 - DNA, 2232 bp, Homo sapiens
  Payload ID: 11471
  Gene Symbol: NUSAP1
  Gene Name: nucleolar and spindle associated protein 1
  Uniprot ID: Q9BXS6
  ENST ID: ENST00000560177
  CDS Start-End: 46-1368
gtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 161143 - DNA, 2256 bp, Homo sapiens
  Payload ID: 11471
  Gene Symbol: NUSAP1
  Gene Name: nucleolar and spindle associated protein 1
  Uniprot ID: Q9BXS6
  ENST ID: ENST00000560747
  CDS Start-End: 73-1392
gccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 161144 - DNA, 1632 bp, Homo sapiens
  Payload ID: 11472
  Gene Symbol: NOC4L
  Gene Name: nucleolar complex associated 4 homolog
  Uniprot ID: Q9BVI4
  ENST ID: ENST00000330579
  CDS Start-End: 42-1592
ccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccagcc

SEQ ID NO: 161145 - DNA, 1009 bp, Homo sapiens
  Payload ID: 11472
  Gene Symbol: NOC4L
  Gene Name: nucleolar complex associated 4 homolog
  ENST ID: ENST00000541954
  CDS Start-End: 199-1009
cgagggggaagggaacgggttgggggcagcctaggcaggggcgaaggtgacagttggcggccgggcaccctgccgccgcctctcctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaagacgctcctcataagggggatcatacggtatgtggcttcttccactcatcggcgtgttcgaagttcgttctctttgtggctgagtagcagcgcgtcgtatagcacagcacgtatcgttcagccgctcgagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcggtgagtgcc

SEQ ID NO: 161146 - DNA, 3333 bp, Homo sapiens
  Payload ID: 11473
  Gene Symbol: NOL10
  Gene Name: nucleolar protein 10
  Uniprot ID: Q9BSC4
  ENST ID: ENST00000345985
  CDS Start-End: 112-2028
cggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcagggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggttgagagcatcccaaatccgaaaatctaaaactgtttgagcactgtatttatctgttcttgcactgctataaagaactacctgaaactgggtaatttataagtaaagaaaagaggtttaattgactcacagttctacaggtggtacaggaagcatggctgtggaggccctgggaagcttacaatcgtggcagaaggtgaagcggaagcaggtatgtcctgcgtggctagagccagaggaggagggcaaaggggcagatgctgcacactttcaaacaccagatctccaagaactcactaacacagaatagcaagggggaagtctgcccccatgtttcagtcacctccctccaggcccctcctccaacaccgaagattacaatttgacatgagatttgtgtggggacacagagcaaaaccatatcaagcactgacatgacattggaggaaaatgctcattagagcttttcaggttttggattttcagatttgggatacttgactagtaaatataatacagatattccaaaacacacaaaaaaaccaaagtctaaaagacttctggtcccaagcatttcagataagggatacccaacctgtaataatgggaaacaagcagtagaggctgttggttaatcttggcacaagtttaattacaggttttttttttttcctgtttcttaagtacagtcaaacataaacttactggaggaaacatttataaaaataaatatactttcatttgaa

SEQ ID NO: 161147 - DNA, 2589 bp, Homo sapiens
  Payload ID: 11473
  Gene Symbol: NOL10
  Gene Name: nucleolar protein 10
  Uniprot ID: Q9BSC4
  ENST ID: ENST00000381685
  CDS Start-End: 107-2173
ccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 161148 - DNA, 827 bp, Homo sapiens
  Payload ID: 11473
  Gene Symbol: NOL10
  Gene Name: nucleolar protein 10
  ENST ID: ENST00000431319
  CDS Start-End: 1-759
attgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccattctctaaaccagtgctgtccagttctctaaaccaaagtctgccaccagcgtttctgtgatgacggacacgttctatatctgctgtgtcctgtgtggtagccattagtcacatgtagctgttgagcac

SEQ ID NO: 161149 - DNA, 3418 bp, Homo sapiens
  Payload ID: 11473
  Gene Symbol: NOL10
  Gene Name: nucleolar protein 10
  Uniprot ID: Q9BSC4
  ENST ID: ENST00000538384
  CDS Start-End: 127-2115
aagtgcgtcatcagtcggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactgttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggttgagagcatcccaaatccgaaaatctaaaactgtttgagcactgtatttatctgttcttgcactgctataaagaactacctgaaactgggtaatttataagtaaagaaaagaggtttaattgactcacagttctacaggtggtacaggaagcatggctgtggaggccctgggaagcttacaatcgtggcagaaggtgaagcggaagcaggtatgtcctgcgtggctagagccagaggaggagggcaaaggggcagatgctgcacactttcaaacaccagatctccaagaactcactaacacagaatagcaagggggaagtctgcccccatgtttcagtcacctccctccaggcccctcctccaacaccgaagattacaatttgacatgagatttgtgtggggacacagagcaaaaccatatcaagcactgacatgacattggaggaaaatgctcattagagcttttcaggttttggattttcagatttgggatacttgactagtaaatataatacagatattccaaaacacacaaaaaaaccaaagtctaaaagacttctggtcccaagcatttcagataagggatacccaacctgtaataatgggaaacaagcagtagaggctgttggttaatcttggcacaagtttaattacaggttttttttttttcctgtttcttaagtacagtcaaacataaacttactggaggaaacatttataaaaataaatatactttcatttg

SEQ ID NO: 161150 - DNA, 2947 bp, Homo sapiens
  Payload ID: 11474
  Gene Symbol: NOL11
  Gene Name: nucleolar protein 11
  Uniprot ID: Q9H8H0
  ENST ID: ENST00000253247
  CDS Start-End: 116-2275
gcgagagcaggttcctggtttggcaagcactcgccccctcaggcccgttcattctcgcgagagaaagcgcgaggcctgccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcaaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtgattctaggaagaatgtaattttatcagagtcagaagctgcccctgctcatttgttccacagctcacctttatttcacacatttgcagtgtgtcttctgccacaagcagggcagagaggggccctcacacaggcacgtgattgcctcctgcggtctcccctgtcctttaggacaaatgaaaagttcaagtgtgattctacagcccagctttacagaaagaatcctgatggctgaatttaccttgcagtagtgaaaagctgcgttttaggtcaggcactgtatgtaaactttagtcacacatgtggccgttaataaacaggttctcctcca

SEQ ID NO: 161151 - DNA, 2448 bp, Homo sapiens
  Payload ID: 11474
  Gene Symbol: NOL11
  Gene Name: nucleolar protein 11
  Uniprot ID: Q9H8H0
  ENST ID: ENST00000581375
  CDS Start-End: 4-513
aaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcaaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtg

SEQ ID NO: 161152 - DNA, 443 bp, Homo sapiens
  Payload ID: 11474
  Gene Symbol: NOL11
  Gene Name: nucleolar protein 11
  ENST ID: ENST00000583021
  CDS Start-End: 1-257
gtagcgaaaatgctactatgactcttcctggaatacacccacctaccttgaaccagattatggattggatatgtctacttctggatgcaaattttactgttgttgtaatgatgccagaagcaaagaggctactgataaatctttacaagcttgtaaaatctcaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 161153 - DNA, 584 bp, Homo sapiens
  Payload ID: 11474
  Gene Symbol: NOL11
  Gene Name: nucleolar protein 11
  ENST ID: ENST00000581106
  CDS Start-End: 18-584
acttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataagaggtttggccggacgcggtggttcacgcctgtaatcccagaacttcgggaggcccaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttatt

SEQ ID NO: 161154 - DNA, 815 bp, Homo sapiens
  Payload ID: 11474
  Gene Symbol: NOL11
  Gene Name: nucleolar protein 11
  ENST ID: ENST00000580833
  CDS Start-End: 1-815
gttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaagggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttctta

SEQ ID NO: 161155 - DNA, 2854 bp, Homo sapiens
  Payload ID: 11475
  Gene Symbol: NOL12
  Gene Name: nucleolar protein 12
  Uniprot ID: Q9UGY1
  ENST ID: ENST00000359114
  CDS Start-End: 71-712
gcgcccgggaggatgagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactcctttcca

SEQ ID NO: 161156 - DNA, 945 bp, Homo sapiens
  Payload ID: 11475
  Gene Symbol: NOL12
  Gene Name: nucleolar protein 12
  Uniprot ID: Q9UGY1
  ENST ID: ENST00000438329
  CDS Start-End: 71-712
gcgcccgggaggatgagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtgtgcctaccgcatgttgccgctgctgtttctgctgggacgtctgactccagttccttctcccctctccagtgacaaggtcatttacaacttacatttacaatttatagtgtttaccagtattaaattctcagccactcctttc

SEQ ID NO: 161157 - DNA, 903 bp, Homo sapiens
  Payload ID: 11475
  Gene Symbol: NOL12
  Gene Name: nucleolar protein 12
  Uniprot ID: Q9UGY1
  ENST ID: ENST00000611699
  CDS Start-End: 34-675
cttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 161158 - DNA, 1394 bp, Homo sapiens
  Payload ID: 11476
  Gene Symbol: NOL3
  Gene Name: nucleolar protein 3 (apoptosis repressor with CARD domain)
  Uniprot ID: O60936
  ENST ID: ENST00000268605
  CDS Start-End: 87-713
gccgcagctgctgcacccacccccaccctgcccggccctttctgcaccgtcatctcctgccccgccgaggcttgacccccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttcc

SEQ ID NO: 161159 - DNA, 642 bp, Homo sapiens
  Payload ID: 11476
  Gene Symbol: NOL3
  Gene Name: nucleolar protein 3 (apoptosis repressor with CARD domain)
  ENST ID: ENST00000563439
  CDS Start-End: 227-642
gccgcagctgctgcacccacccccaccctgcccggccctttctgcaccgtcatctcctgccccgccgaggcttgacccgtgctgtccccctctcccttcctttgcccaccgattggagggacactctggaaaactcagttgaagaaagcggagagtctgcgtgtacacagtgcaatgatgtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccc

SEQ ID NO: 161160 - DNA, 1351 bp, Homo sapiens
  Payload ID: 11476
  Gene Symbol: NOL3
  Gene Name: nucleolar protein 3 (apoptosis repressor with CARD domain)
  Uniprot ID: O60936
  ENST ID: ENST00000568146
  CDS Start-End: 54-713
ctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttcc

SEQ ID NO: 161161 - DNA, 752 bp, Homo sapiens
  Payload ID: 11476
  Gene Symbol: NOL3
  Gene Name: nucleolar protein 3 (apoptosis repressor with CARD domain)
  ENST ID: ENST00000566871
  CDS Start-End: 1-650
caggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctggg

SEQ ID NO: 161162 - DNA, 1592 bp, Homo sapiens
  Payload ID: 11476
  Gene Symbol: NOL3
  Gene Name: nucleolar protein 3 (apoptosis repressor with CARD domain)
  Uniprot ID: O60936
  ENST ID: ENST00000564053
  CDS Start-End: 349-1161
gcaccgtcatctcctgccccgccgaggcttgacccgtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcataagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagc

SEQ ID NO: 161163 - DNA, 677 bp, Homo sapiens
  Payload ID: 11476
  Gene Symbol: NOL3
  Gene Name: nucleolar protein 3 (apoptosis repressor with CARD domain)
  ENST ID: ENST00000564992
  CDS Start-End: 59-677
tgcccggccctttctgcaccgtcatctcctgccccgccgaggcttgacccccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaag

SEQ ID NO: 161164 - DNA, 579 bp, Homo sapiens
  Payload ID: 11476
  Gene Symbol: NOL3
  Gene Name: nucleolar protein 3 (apoptosis repressor with CARD domain)
  ENST ID: ENST00000565560
  CDS Start-End: 57-579
gcttctgggtcgcgctcagctctgcaatgcatgcgttctgtgatcctgccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagc

SEQ ID NO: 161165 - DNA, 317 bp, Homo sapiens
  Payload ID: 11476
  Gene Symbol: NOL3
  Gene Name: nucleolar protein 3 (apoptosis repressor with CARD domain)
  ENST ID: ENST00000564860
  CDS Start-End: 1-317
agagctggaacccgaggctgaagcagaaccagagccggaactggagccagaaccggacccagagcccgagcccgacttcgaggaaagggacgagtccgaaggtattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagg

SEQ ID NO: 161166 - DNA, 794 bp, Homo sapiens
  Payload ID: 11476
  Gene Symbol: NOL3
  Gene Name: nucleolar protein 3 (apoptosis repressor with CARD domain)
  ENST ID: ENST00000563258
  CDS Start-End: 1-395
cgagttccccgtgttggcctccaggtcctgtgcttgcggagccgtccggcggctgggatcgaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaa

SEQ ID NO: 161167 - DNA, 3957 bp, Homo sapiens
  Payload ID: 11477
  Gene Symbol: NOL4
  Gene Name: nucleolar protein 4
  Uniprot ID: O94818
  ENST ID: ENST00000261592
  CDS Start-End: 299-2215
ggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaa

SEQ ID NO: 161168 - DNA, 1979 bp, Homo sapiens
  Payload ID: 11477
  Gene Symbol: NOL4
  Gene Name: nucleolar protein 4
  Uniprot ID: O94818
  ENST ID: ENST00000538587
  CDS Start-End: 32-1726
aagaagatgggaactgtgggctacaagtaggatggcagatctgatgcaggagacctttctgcatcatgccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatca

SEQ ID NO: 161169 - DNA, 1853 bp, Homo sapiens
  Payload ID: 11477
  Gene Symbol: NOL4
  Gene Name: nucleolar protein 4
  Uniprot ID: O94818
  ENST ID: ENST00000535384
  CDS Start-End: 240-1301
cttactgtgcagaggagagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcata

SEQ ID NO: 161170 - DNA, 2193 bp, Homo sapiens
  Payload ID: 11477
  Gene Symbol: NOL4
  Gene Name: nucleolar protein 4
  ENST ID: ENST00000586314
  CDS Start-End: 258-467
acaaataaagccgcagctagaagatgaacaacaaagaaagatgggtttaggcgctatcgaatggtgtgtgtatttgttcctttttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggatggcagatctgatgcaggagacctttctgcatcatgccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatacagaaaaatgtgtgaaatgctcaaagtttcaaatacagatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggc

SEQ ID NO: 161171 - DNA, 565 bp, Homo sapiens
  Payload ID: 11477
  Gene Symbol: NOL4
  Gene Name: nucleolar protein 4
  ENST ID: ENST00000586309
  CDS Start-End: 229-303
aacaaagaaagatgggtttaggcgctatcgaatggtgtgtgtatttgttcctttttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggatggcagatctgatgcaggagacctttctgcatcatgccacgggatataccacaatttacccatttacttgttgaaggacatctgaatgatttccatttttggcaattatgaatagagctgctacaattgcatacaagtttttatgtgaatgatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcg

SEQ ID NO: 161172 - DNA, 2221 bp, Homo sapiens
  Payload ID: 11477
  Gene Symbol: NOL4
  Gene Name: nucleolar protein 4
  Uniprot ID: O94818
  ENST ID: ENST00000589544
  CDS Start-End: 219-1829
cgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggc

SEQ ID NO: 161173 - DNA, 838 bp, Homo sapiens
  Payload ID: 11477
  Gene Symbol: NOL4
  Gene Name: nucleolar protein 4
  ENST ID: ENST00000586553
  CDS Start-End: 182-838
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactca

SEQ ID NO: 161174 - DNA, 544 bp, Homo sapiens
  Payload ID: 11477
  Gene Symbol: NOL4
  Gene Name: nucleolar protein 4
  ENST ID: ENST00000591917
  CDS Start-End: 50-259
agcgtcgattttcttcacaagaagatgggaactgtgggctacaagtaggatggcagatctgatgcaggagacctttctgcatcatgccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaggcccaagggaaatataaatgtatcatattacacatactcttcaggaaaaatcaagacaggaagaggttttccacactcccatatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaag

SEQ ID NO: 161175 - DNA, 1930 bp, Homo sapiens
  Payload ID: 11477
  Gene Symbol: NOL4
  Gene Name: nucleolar protein 4
  ENST ID: ENST00000590712
  CDS Start-End: 1-1677
aggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatca

SEQ ID NO: 161176 - DNA, 971 bp, Homo sapiens
  Payload ID: 11478
  Gene Symbol: NOL4L
  Gene Name: nucleolar protein 4-like
  ENST ID: ENST00000201961
  CDS Start-End: 221-748
ggagctgggccgccagttccgggactggtgcttgcgcacctacggcgactcggccaaaaccaagacggtgacacgcagcaaataccagcggatcgccgaggtcctgcagggcggcggcgggactggcgcgggcagcggccccgcagccggcgagaaaggcaagttccagttctgggtgcgctccaagggcttccgcctgggcagcggccgggaacccaagatgggccaagtggtgtatgtgccggtcaagacgggctcgggggcagatggcctgtcggagccagagggcatctctctgaagcgggtcgctgtggtggaagatttctttgacatcatctactcgatgcatgtggagagctcagcggagccaggcaaagcccccaagcacgctgggcagaagaaaacctaccgagcgatcgcagagacctatgccttcctcccgagagaggccgtgacccggttcctgatgagctgtacggagtgtcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcagtgcctcccttcaggagccgaggacatcatgtctggtggccccactttggaggctgctgaatttgatgacttgattgggaagtgtctgccagatcgccccattgcagagtgaggatggacagttcccgcgtttggaaacacatttcctggatgaacttaagagctgtggccactagttcgttctaaaaatcattattgggcaccagcatgtgtggataaataaagcctcccacctgccccacatcaccaaggatgagaagatccagtaaactggggagagtgaattggtttgaaaacacatttgatttcaggaataaaaggtgcaaatgagtaaa

SEQ ID NO: 161177 - DNA, 701 bp, Homo sapiens
  Payload ID: 11478
  Gene Symbol: NOL4L
  Gene Name: nucleolar protein 4-like
  ENST ID: ENST00000326071
  CDS Start-End: 255-530
ggcgccgccgccgctgccgccgctgctcgcctgggccctcctcctggccacccccgcccccgggccgggcagtgacgcgccgcggtggtgccagcccctctccccgggcagccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattaaaattga

SEQ ID NO: 161178 - DNA, 5991 bp, Homo sapiens
  Payload ID: 11478
  Gene Symbol: NOL4L
  Gene Name: nucleolar protein 4-like
  Uniprot ID: Q96MY1
  ENST ID: ENST00000359676
  CDS Start-End: 144-1454
ccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccacgcccaccccctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgttctgaacagctgtaaccccaactcccccacacaatgtgtctgcctgggaggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctggagtgtgaaaaagggcaaaaagaaaaagctggcctggtttccttcctccctgattgattgattgataggcacttcctcttgctcagtgcaatacctaccagtgctgctaaaccagggactcgcccagacctcagcaggcccccagggcctctccgtgcaacactccgtagccatgacagcagctctctgctgcccgcccctgcccagagctggcagaagccctctgttgcctttcctccctcagagcagagaggccccaggggagccagggccgagtggatcctaggatggccacggagagccactcgctcccagaacaggcaccccttcccaaaccagcttttctgcagccaattgcctgttgcagctgtggccactgcctcccggcactgtggcagactccccccaaggagggatggggggggcaccagtgaggatgccccatcctgcctcaggtccagaactctgaaaggtagggtgcccaccccgtgcttacttccggcccctagaggttgggggtggtcgttatctctcaagtggcctccaataccccatccagccacaccacctctgccttccatctgaccaatccccaggcctctggtcagggccaggacacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgatttttatataatttagtggtgctttagaaactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaa

SEQ ID NO: 161179 - DNA, 541 bp, Homo sapiens
  Payload ID: 11478
  Gene Symbol: NOL4L
  Gene Name: nucleolar protein 4-like
  ENST ID: ENST00000375677
  CDS Start-End: 29-370
gcccctcacctccacctacctgaagcagatgaagcttcgagtgatgaattcccaggagcaggatgagacttctgtgagcagcgaggattttgatatgagcgactccacatggatgtcagctgacccgcacctggcctccagcctgagccccagccaggacgagaggatgcggagcccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattaaaattga

SEQ ID NO: 161180 - DNA, 2042 bp, Homo sapiens
  Payload ID: 11478
  Gene Symbol: NOL4L
  Gene Name: nucleolar protein 4-like
  ENST ID: ENST00000375678
  CDS Start-End: 1252-1719
ccccctccagccccacctcttcccccggccctgggtggggcccgcacctggggctctccgctcgttagcgcgcccagggcgcctcctcggcccgagagggacccgcccgcggggcctggctggctcagggctacctccttccgcctaggacccccccttcggtgactcccgattccctgtcctaggctgcggtgccccgggaggcgggtcgccagagtagcagacagagctctttaatgggtgtcttctagggcgggtgctgtttgtgcatcatttgggttcccacacacttcctatgaggtggcgaaagccattatgcctatggtgtctgctcacacagggggaaactgaggcccaggcaggacagccccttgcctggggtgggggctgggttgtccttaggcctgtgacttcacctctacagcaccctcctgtggaccctctccctgcccccgccaggccagagtcctgcagccaggcccagaccctggcctgtccgtccggggatgctggacagtactcctccctccagccctcataagtcattgtcattcggatctgcatttccccagcccctctccttctaactggggggcactgtggcccactgtgcccctttctcttcccattccttccccctacacccattccagacatcccagagttaacaaaacccaaaagaaagagaaaaaagactcagagctgcttggaggagatgacatcctcaaatgtagcgccgttgtttgaggggctggtcccaggcacctttctctgtggcctggggtgtgcgttttggtccccagcgtgatttgaaagaagatggaggttcagcgaagcagaaaggaggtcttggaatatgtgaggcctgttccagatggcaggtgcgactcggtggtggcggtggcggcggcagctacgcgctaacagttggagattgtgcacaagggtggagaagagttacctccctggctcaatcatggagacattctgatcagcagttctcaaaatctgtcttgcatcagaatcatctgggggggcctgttaaaacccccagcacatcagatttgggttctccttgaaggccacgtagacatcctggcgttcttcccctagggtgtagcacacatggaatccaggtggccctagctcaccagaggacagttcaagggggcagatggcctgtcggagccagagggcatctctctgaagcgggtcgctgtggtggaagatttctttgacatcatctactcgatgcatgtggagagctcagcggagccaggcaaagcccccaagcacgctgggcagaagaaaacctaccgagcgatcgcagagacctatgccttcctcccgagagaggccgtgacccggttcctgatgagctgtacggagtgtcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcaggatgagacttctgtgagcagcgaggattttgatatgagcgactccacatggatgtcagctgacccgcacctggcctccagcctgagccccagccaggacgagaggatgcggagcccgcagaacctccacagtcaagaggacggtggtgtctgtctccagggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattaaaattga

SEQ ID NO: 161181 - DNA, 311 bp, Homo sapiens
  Payload ID: 11478
  Gene Symbol: NOL4L
  Gene Name: nucleolar protein 4-like
  ENST ID: ENST00000419612
  CDS Start-End: 1-229
tcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcagccatcctcactgtctccggcacctggcttcgtaaacactgttatcaccgtgctcatctgtgcccatgaagaatgaagcacaaaaccgcacaaacagccggaagcacagccccctggttttgtttcatacagaatggcactaaatccaggtcaccact

SEQ ID NO: 161182 - DNA, 1376 bp, Homo sapiens
  Payload ID: 11478
  Gene Symbol: NOL4L
  Gene Name: nucleolar protein 4-like
  ENST ID: ENST00000616976
  CDS Start-End: 27-1229
cttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccacgcccaccccctggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatgg

SEQ ID NO: 161183 - DNA, 6761 bp, Homo sapiens
  Payload ID: 11478
  Gene Symbol: NOL4L
  Gene Name: nucleolar protein 4-like
  ENST ID: ENST00000621426
  CDS Start-End: 184-2226
cgcgccgcagccccgcgcgtccggccgccgcccgcgcccatccagcagcctcgccggagccacaccgcgggacagacgcggccgcggcgcgtcccggcccggtccagcccagcccagcccagtcccggcaccgggcggcccggcggccggcccgcccccgagggcgccgggcgcggcgggaggatgccgaagccgacgctgctgctgcgcgggggctgggagcgcgagcgcagccccggggactcggagctgggccgccagttccgggactggtgcttgcgcacctacggcgactcggccaaaaccaagacggtgacacgcagcaaataccagcggatcgccgaggtcctgcagggcggcggcgggactggcgcgggcagcggccccgcagccggcgagaaaggcaagttccagttctgggtgcgctccaagggcttccgcctgggcagcggccgggaacccaagatgggccaagtggtgtatgtgccggtcaagacgggctcgggggcagatggcctgtcggagccagagggcatctctctgaagcgggtcgctgtggtggaagatttctttgacatcatctactcgatgcatgtggagagctcagcggagccaggcaaagcccccaagcacgctgggcagaagaaaacctaccgagcgatcgcagagacctatgccttcctcccgagagaggccgtgacccggttcctgatgagctgtacggagtgtcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcaggatgagacttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccacgcccaccccctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgttctgaacagctgtaaccccaactcccccacacaatgtgtctgcctgggaggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctggagtgtgaaaaagggcaaaaagaaaaagctggcctggtttccttcctccctgattgattgattgataggcacttcctcttgctcagtgcaatacctaccagtgctgctaaaccagggactcgcccagacctcagcaggcccccagggcctctccgtgcaacactccgtagccatgacagcagctctctgctgcccgcccctgcccagagctggcagaagccctctgttgcctttcctccctcagagcagagaggccccaggggagccagggccgagtggatcctaggatggccacggagagccactcgctcccagaacaggcaccccttcccaaaccagcttttctgcagccaattgcctgttgcagctgtggccactgcctcccggcactgtggcagactccccccaaggagggatggggggggcaccagtgaggatgccccatcctgcctcaggtccagaactctgaaaggtagggtgcccaccccgtgcttacttccggcccctagaggttgggggtggtcgttatctctcaagtggcctccaataccccatccagccacaccacctctgccttccatctgaccaatccccaggcctctggtcagggccaggacacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgatttttatataatttagtggtgctttagaaactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccg

SEQ ID NO: 161184 - DNA, 4741 bp, Homo sapiens
  Payload ID: 11479
  Gene Symbol: NOL6
  Gene Name: nucleolar protein 6 (RNA-associated)
  Uniprot ID: Q9H6R4
  ENST ID: ENST00000297990
  CDS Start-End: 89-3529
ggagttaggcatttccgcccacgtgggaagctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaa

SEQ ID NO: 161185 - DNA, 3411 bp, Homo sapiens
  Payload ID: 11479
  Gene Symbol: NOL6
  Gene Name: nucleolar protein 6 (RNA-associated)
  Uniprot ID: Q9H6R4
  ENST ID: ENST00000353159
  CDS Start-End: 89-2188
ggagttaggcatttccgcccacgtgggaagctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaatttcccccgta

SEQ ID NO: 161186 - DNA, 2190 bp, Homo sapiens
  Payload ID: 11479
  Gene Symbol: NOL6
  Gene Name: nucleolar protein 6 (RNA-associated)
  ENST ID: ENST00000379470
  CDS Start-End: 376-978
actttttccccagctgagaagtttccttgcggccagccatcatccttcgtgctgcaccctaagtctacatgggaatgggtggttgagcaagtggcagaaggggttctaagatgccctgccctgccaatccacaccagggggtctgagctccatagcctgagagaagcctggggatatgtggctgggccctggattctttgcttactccagccctttagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaa

SEQ ID NO: 161187 - DNA, 3843 bp, Homo sapiens
  Payload ID: 11479
  Gene Symbol: NOL6
  Gene Name: nucleolar protein 6 (RNA-associated)
  ENST ID: ENST00000379471
  CDS Start-End: 89-3113
ggagttaggcatttccgcccacgtgggaagctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaa

SEQ ID NO: 161188 - DNA, 646 bp, Homo sapiens
  Payload ID: 11480
  Gene Symbol: NOL7
  Gene Name: nucleolar protein 7, 27kDa
  ENST ID: ENST00000420088
  CDS Start-End: 1-250
cccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaaggtatgactattctaatttaactaacttctcatgtaagtgtcaagtgcacttgcagatgtttccagtcaaatatgaatggcccttagaaagccagcatgggcctggccaaggttagctggggcctattccctgtatttcatacaaataaaaactgcatccacattggtgtgtagtggatgcttaaagtgaactccagtaaatttcctgatttatttttacgtgaatgctaattagaaaatgtaactctattttttagttaatttgcaaaagaaaaatgaagactgtgaaaaaggaaatgactccaagaaagttaaagtacaaaaagtacagtctgtcaggtaatgagtcttttgtttcatttgggatgtaaaggagacctttaagagagttaaagtattggctaacatgggaaaata

SEQ ID NO: 161189 - DNA, 1184 bp, Homo sapiens
  Payload ID: 11480
  Gene Symbol: NOL7
  Gene Name: nucleolar protein 7, 27kDa
  Uniprot ID: Q9UMY1
  ENST ID: ENST00000451315
  CDS Start-End: 33-806
cagaggtcagacggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatata

SEQ ID NO: 161190 - DNA, 4422 bp, Homo sapiens
  Payload ID: 11481
  Gene Symbol: NOL8
  Gene Name: nucleolar protein 8
  Uniprot ID: Q76FK4
  ENST ID: ENST00000358855
  CDS Start-End: 646-3945
cttacgccgacctagtccaggaattggtacacacagcgatagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgtattttccagcctaggctttgtgtgaattataggctatttgaaattttatttctgattatgtcaaatacaccttccattttgtcatttttgtttaaactgataaattacaagtcaacattgagtttt

SEQ ID NO: 161191 - DNA, 4341 bp, Homo sapiens
  Payload ID: 11481
  Gene Symbol: NOL8
  Gene Name: nucleolar protein 8
  ENST ID: ENST00000360868
  CDS Start-End: 500-760
ggaggaagaaggctggggtgggtaggttgggggtggagacaattaggaagaggtaggctagctctttttatcttttagtgcgttacatcctgtttctgtcagactttgttaaagacagtaaatgaatgtatgagtgagtcaaggaaaaacatctaaaaacatgaatacataaaattaagagggatagagtgtaatattatggccatttggaggaaaaaaactctgtctgtacctgtgtctatatgggtatggggttgctgttccaaagtgcattcatgaaagatgtggatgtagggcttgggcaaaacctcgaagactaaaatttggaagtaatacaataggaagtgaaatacagatccaggagacggatttgatacagaaggttcagaggaagtagttgttttgttagattttagaagaactaagggaaagaactcttctctgtatacagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaa

SEQ ID NO: 161192 - DNA, 572 bp, Homo sapiens
  Payload ID: 11481
  Gene Symbol: NOL8
  Gene Name: nucleolar protein 8
  ENST ID: ENST00000411621
  CDS Start-End: 134-572
aaggaagagaggatgctccgttgggacacgtgaccagaagttaggggctgcagcggcgctggctttaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatg

SEQ ID NO: 161193 - DNA, 1098 bp, Homo sapiens
  Payload ID: 11481
  Gene Symbol: NOL8
  Gene Name: nucleolar protein 8
  ENST ID: ENST00000421075
  CDS Start-End: 326-1098
cttacgccgacctagtccaggaattggtacacacagcgatagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaac

SEQ ID NO: 161194 - DNA, 1044 bp, Homo sapiens
  Payload ID: 11481
  Gene Symbol: NOL8
  Gene Name: nucleolar protein 8
  ENST ID: ENST00000445919
  CDS Start-End: 182-487
cgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacaggaggatatggataatcaagacctaacaaattgggctccgaaagataccttcgtcatggggaagagtgaatggagagaagataatataaaatgccaaacgtatataaattgaaaggggaaaattgagagaacttgcgatccatggtcttggtcttccataaaggggaactgggacatccactggagcagagcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagt

SEQ ID NO: 161195 - DNA, 4281 bp, Homo sapiens
  Payload ID: 11481
  Gene Symbol: NOL8
  Gene Name: nucleolar protein 8
  Uniprot ID: Q76FK4
  ENST ID: ENST00000442668
  CDS Start-End: 300-3803
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgtattttccagcctaggctttgtgtgaattataggctatttgaaattttatttctgattatgtcaaatacaccttccattttgtcatttttgtttaaactgataaattacaagtcaacattgagtttta

SEQ ID NO: 161196 - DNA, 1396 bp, Homo sapiens
  Payload ID: 11481
  Gene Symbol: NOL8
  Gene Name: nucleolar protein 8
  ENST ID: ENST00000433029
  CDS Start-End: 156-1396
ctccgttgggacacgtgaccagaagttaggggctgcagcggcgctggctttaggtgaacgacgtgattttagaagaactaagggaaagaactcttctctgtatacagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaa

SEQ ID NO: 161197 - DNA, 3136 bp, Homo sapiens
  Payload ID: 11481
  Gene Symbol: NOL8
  Gene Name: nucleolar protein 8
  ENST ID: ENST00000432670
  CDS Start-End: 228-3136
acgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagc

SEQ ID NO: 161198 - DNA, 3400 bp, Homo sapiens
  Payload ID: 11481
  Gene Symbol: NOL8
  Gene Name: nucleolar protein 8
  ENST ID: ENST00000434228
  CDS Start-End: 87-347
aggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagcagttgccagcctactgtgtacaggcactagagccccatgctgagcaggttgagcacacagtgctgctgcttggagtatctgcgtggatatgcctgagaagcatgggtctgatggttattctgggacataaaggagacagaccagaggcaaagaggccagtgaggactgctctgtgcagttgtccaggcctgaagaaggtggcggtgatttgaatcagaagaggtggcattctcttcattaggaggatatggataatcaagacctaacaaattgggctccgaaagataccttcgtcatggggaagagtgaatggagagaagataatataaaatgccaaacgtatataaattgaaaggggaaaattgagagaacttgcgatccatggtcttggtcttccataaaggggaactgggacatccactggagcagagcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaa

SEQ ID NO: 161199 - DNA, 639 bp, Homo sapiens
  Payload ID: 11481
  Gene Symbol: NOL8
  Gene Name: nucleolar protein 8
  ENST ID: ENST00000543260
  CDS Start-End: 206-466
gcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaa

SEQ ID NO: 161200 - DNA, 4598 bp, Homo sapiens
  Payload ID: 11481
  Gene Symbol: NOL8
  Gene Name: nucleolar protein 8
  ENST ID: ENST00000544867
  CDS Start-End: 82-3339
ctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagacagagtctctgtcacccaggctggagtgcagtggtgcaatctcggttcactagcagataataccaactccgtggtactttaaaaggaagtataacaatctagtagttgttcaaaaagtattgcaaataagacttcattttcttgtctatataaactgttgagtagagttggcatgatgtaaatagtaacgatagtttttctaactttgagagcaaaacgtgagaaattgaccttgaaacgagtcctaaagacatcagcaacttgaaagatgttttttaagtacttgggaaattttgaagacttgtgaggtgattgtcctgatcttatagcagtagtttttccagcagttctagcaaaaagttttgggtattgaaaatgtaaagatatattccttttctcatttataaatagacaagagggaaacctgatttccctgtatcctattatattttaggcttctcatgcaagcacagatgccatggttattttaggtgtcatttttaaaaattatatagctcatttataaacctttattttttaaaccttttttatattactgctgtccttatcagatcattctagcaatgccaaaattatgatagtggcttctgaaaatatttgaaaaatctaaaaagatgatactacctatttttttgatactattttaaattaatgattaacatattggaactttagatatgtctacgtggtaaaagtaatcaaatgaatgtgttcagaaatacttggctgtggagttacaatcccatcatcttttgttgtcataacgatatagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaag

SEQ ID NO: 161201 - DNA, 2090 bp, Homo sapiens
  Payload ID: 11481
  Gene Symbol: NOL8
  Gene Name: nucleolar protein 8
  ENST ID: ENST00000545444
  CDS Start-End: 252-644
cgccgacctagtccaggaattggtacacacagcgatagtgttcaatagaaactaggggattttggaaattaaaagctcttgggaactgaattgtggtaacggaaccttaggaggctgggttggaaatcgagtaggaaggaagagaggatgctccgttgggacacgtgaccagaagttaggggctgcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacaggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgtattttccagcctaggctttgtgtgaattataggctatttgaaattttatttctgattatgt

SEQ ID NO: 161202 - DNA, 557 bp, Homo sapiens
  Payload ID: 11481
  Gene Symbol: NOL8
  Gene Name: nucleolar protein 8
  ENST ID: ENST00000542573
  CDS Start-End: 92-352
aagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgtt

SEQ ID NO: 161203 - DNA, 3393 bp, Homo sapiens
  Payload ID: 11481
  Gene Symbol: NOL8
  Gene Name: nucleolar protein 8
  Uniprot ID: Q76FK4
  ENST ID: ENST00000542053
  CDS Start-End: 94-3393
gcggcgctggctttaggtgaacgacgtggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataa

SEQ ID NO: 161204 - DNA, 4343 bp, Homo sapiens
  Payload ID: 11481
  Gene Symbol: NOL8
  Gene Name: nucleolar protein 8
  Uniprot ID: Q76FK4
  ENST ID: ENST00000545558
  CDS Start-End: 494-3997
agaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagaggtaggccgaagttctgcccagaatacacgccatgtggtggacgctggttgggagtctcttctggaaagagtctgtcagctcttggggaagggaagggcgagagctgagcgcctgccgggtgctaaacgaaatgagagatactatgatgggccctagtacctctggaaaagttttcctgagtcccctgtgatacagcaaccttcatagtatagtgttaagaattccaagttctgaaggtagacctgcattataatcctggattcactaattttcgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagca

SEQ ID NO: 161205 - DNA, 3390 bp, Homo sapiens
  Payload ID: 11481
  Gene Symbol: NOL8
  Gene Name: nucleolar protein 8
  Uniprot ID: Q76FK4
  ENST ID: ENST00000535387
  CDS Start-End: 1-3390
atgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataa

SEQ ID NO: 161206 - DNA, 551 bp, Homo sapiens
  Payload ID: 11481
  Gene Symbol: NOL8
  Gene Name: nucleolar protein 8
  ENST ID: ENST00000536624
  CDS Start-End: 117-551
gtggaggggagcgcctctttatttttttcacctacttcctctcttacgccgacctagtccaggaattgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaa

SEQ ID NO: 161207 - DNA, 421 bp, Homo sapiens
  Payload ID: 11481
  Gene Symbol: NOL8
  Gene Name: nucleolar protein 8
  ENST ID: ENST00000542613
  CDS Start-End: 266-421
ggcgctggctttaggtgaacgacgtgttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagaca

SEQ ID NO: 161208 - DNA, 575 bp, Homo sapiens
  Payload ID: 11481
  Gene Symbol: NOL8
  Gene Name: nucleolar protein 8
  ENST ID: ENST00000535807
  CDS Start-End: 249-575
tctttgggtcttctaggaggaagaaggctggggtgggtaggttgggggtggagacaattaggaagaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaag

SEQ ID NO: 161209 - DNA, 754 bp, Homo sapiens
  Payload ID: 11481
  Gene Symbol: NOL8
  Gene Name: nucleolar protein 8
  ENST ID: ENST00000544321
  CDS Start-End: 105-365
gacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagcagcagttgccagcctactgtgtacaggcactagagccccatgctgagcaggttgagcacacagtgctgctgcttggagtatctgcgtggatatgcctgagaagcatgggtctgatggttattctgggacataaaggagacagaccagaggcaaagaggccagtgaggactgctctgtgcagttgtccaggcctgaagaaggtggcggtgatttgaatcagaagaggtggcattctcttcattaggaggatat

SEQ ID NO: 161210 - DNA, 4053 bp, Homo sapiens
  Payload ID: 11481
  Gene Symbol: NOL8
  Gene Name: nucleolar protein 8
  ENST ID: ENST00000536593
  CDS Start-End: 82-342
agaagttaggggctgcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgta

SEQ ID NO: 161211 - DNA, 6649 bp, Homo sapiens
  Payload ID: 11482
  Gene Symbol: NOL9
  Gene Name: nucleolar protein 9
  Uniprot ID: Q5SY16
  ENST ID: ENST00000377705
  CDS Start-End: 34-2142
agattctcgcgcggtaggccctgaggacccagcatggcggactcgggactgctgctaaagcggggttcctgccgttccacttggctgcgggtccgcaaggcccggccccagctcatcctcagccgccggccccgccgccggctcgggagcctgcgctggtgcggtcggcggcgcctacggtggcggttactgcaagcccaggcgtccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccactcttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaattttaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattagcaacagtgttttttgtgtaattcgtgaatgtcatatagtagtcttaagtttctcttttaaagctgcatgagctagaatttgttctagtcttctgtgtgatactcatacttgctgtccagagggagtaaaacagcagagaacagtttgtgtgccattaaaacagagattcctcagaaagttcttcagggacctggttattagaatcaggataaaaataaggaaactggggccattacaatgtaccgagaaggaaggaagaaggccgacctgcaggatctcaagcataatggatacaagggctcgccacgggccttgcctgagccatgtgcagagctggggtccagcggtctgcttccttggagccagtgtggatggttacagcccatccatttggtgcagttgtacttggtctgttatattcaatcaaggtttaatagatagggctgggcatggtggctcatgcacacctgtaatcctagcactttgggaggctgaggcgggaggattgcttgagcctcggagttccaggctggagtacaccaactactccagcctgagcgacagagtaagaccttatcttttaaaaaagaaaagaaaaatttaaacgggtttgatagatataaatttggacccaagagcccttccttttttttaatcctgaggttttatgctgaggaaatttctttcaaatctggaaaacctcggggccaggcgcagtggctcacgcctgtaattccagcactttgggaggccaaggcaggcggttcacgaggtcaggagattgagaccatcctggctaacacagtgaaactccgtctctactaaaaatacaaaaaactagctgggcgtggtggtgggcgcctatagtcccagctactcaggaggctgaggcaggagaatggcatgaacccaggaggcggagcttgcagtgagccgaggtcacgccactgcactccagcctgggcaacaagagcaagactccatctcaaaaaaaaaaaataataatctggaaaacctcttctgggggctcttataaaagtagatttgtccaaattgacttctgatctgaggccagagacaaccacagggcagagctggagactgggctgttttgaaggaagaaggactggcagaccagctcttgggaaagctccattattgcctgtgggaggctggacctgaacttgcacctatgaacaaccctgccatttagagctttttcctgggggtgccggcggctggtgaccagactgccattctccacgttctccctggtgcttccgactctgtcctctaggttggaagtggtttgtgtaaacgggtgatgggaccaggtcacatcatttctgcatttaagacagcaggatacttcctggggctgaggttcaaactggtattgtgaccaccgctttgacagaattccatcttcccagcatgatcacattgtaagactattaggatgtgtgggttttaacacttatatacacttatacaactgttggttatcattgtctttagtattttacagtggcccctcagcacctcttagacccaacagcaaaggacttaaaataagcacaggaaaccttgctatggtgattagttttgatacctttgagacaattgagtctagcttcttagttgccccttatttatgttgaaatctggctcattcatatgatgttttactgtgctggccttgtaaagaattttaagacaatccatcaccatcaatgttttgcctttctccactttcgtgtatcttacagttatactcactggaggtcatttgcagcaaggctctggaagaatgaaactggtgccctgtaattgcatttgcattcaatctaggtttgccttcaggctttaaatgcggcctgtatgaaggtcaagtctttttcttcagtccctatcagtaaagaaaaatcgttgcctctagagggagctatcagctgtgggtcaggtggccgtactggggctagagttggcccaggaagctgtacagggtttagggaaggaggttcggagacagggagccaaggcctctgtcaggtctagcttgtgccggtcagacctgcagcagcaccattctccaggatgacaattcatcccattattgatggcagtggcctttttatccttttttttttttttttttttttttgagatggagtttcgctcttgttgcccaggctggagtgcagtggcgcaatctgggctcactgccacctccgcctcccgggttcaagtgattctcttgcctcaacctcccgagtagctgggattacaggcatgcgccaccatgcctggctgattttctatttttagtagagaaggggtttcaccatgttggccaggctggttttgaactcctgtcctcaggtgatccacctgccttggcctcccaaagtgttgggattacaggcatgagccaccgcacccggctggtggcagtggctttaagggcatttagaagaaggacaagattggactttttatcatttccacagtctgttatgggtcagattaggtagtaaggagttctccattggagctattcttttttttttttctttttttttgagacagagtctcgctctgtcacccaggctggggtgcagtggcacgaccttggctcactacagcctctcccctcccgggttcaagtgattcttctgccccagcctcccaagtagctgggattacaggtgagcgccaccatgcctggctaatttttatatttttagtagagatagggtttcaccgtattggctaggctggtctcgatctcctgaccttgtgatccgcttgcctcggcctcccaaagtgctgaagcaatttcttttttttttttttttttgagacagagtctagctctgtcgcccaggctggggtgcagtggagtgatctcggctcactgcaacttccgcctcccaggtttaagcgattctcctgcctcagcctcctgagtagctgggattacaggcgtatgccaccacgcccagctaatttttgtatttttagtagagacagggtttcaccatgttggtcaggctggtctcgaactcctgacctcgtgatccgcccgccttggcctccgaaagtgctgggattacaggcgtgagccactgcgcctggcctgaagctattctttacaaaagctcttagtttttgtttgtttgtttgtttttttcttttgcgacggactctctgtcgccaaggctggagtgcagtggcctgatctcaggtcactgcaacctctgcctcctgggttcaagcgattctcctgcttcagcctcccaagtagctgggattacaggcgcctgccaccacacccagctaatttttgtatttttagtagagatggcgtttcactttattggtcaggctggtctcgaacttccaacctcaggggatccgcctgccttggcctcccaaggtgttgggattacaggcataagacactgtgcctgggcctcttagtaatttttgtatgtaattttcaaagtatccgggattacaggcgcccgccactacactagctaattttttttgtatttttagtagagatggggttttactatgttggctaggctggtctcgagctcctgacctcgtgatccgtccaccttggcctcccaaagtgctgggattacaggcgtgagccaccgcgcccggcctaggtcatttgtttttgggtttggatggcaagatcatggataagacagcaggctttgattatagagctctgagttcaaatcctggctctaccacttgtcagtggtgtaacttggaggaagatgcttagcctgagcctgttttatgttttgaagattgggtaattgtccttccttcagtgttcctgggtgaggagtaagtgaagtcatgtctataagagatgtagcacagtctccggcatgtagaaacggtcagtaactcctagtgtgtagctagcctctgatgagatggtaaactcaggaggctggcaccacggctgtgctactcacggtcatgctggagggatgcagaaactaaatgaatccacagctacttactcatcttgcctctggcaggttcaccttaaaattgttgctaccaagcttcctgtggtcaaagagcccttgaggaagcaagctccacggccaccatagataacccattcctgaaagtttttcataaacccccacttgttgcttttaaaattttataagcagcttacacatgtagaaaatgatcctccagcccaccaccacatagtaatcactgacactgtgaggtgtctcagctggggttctgctgtgtgtgtgtgtattttacaaaatatgtatggtttctgttcagctcttttcagttaacagatgaacttttgtatcattaaatatttttgaaaacatgaa

SEQ ID NO: 161212 - DNA, 1734 bp, Homo sapiens
  Payload ID: 11483
  Gene Symbol: NIFK
  Gene Name: nucleolar protein interacting with the FHA domain of MKI67
  Uniprot ID: Q9BYG3
  ENST ID: ENST00000285814
  CDS Start-End: 74-955
acttccgcctcgggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatctacatggtttgtcggggacatttaactcatggaggtgctttagatttcaacatcagatggttgaagctggaagtttaattatatgtagagtgagaaggcagttccagttttagcacagatttgtttatgtgttcagattttaatagagattcaaaaatgactcatttttaccaataatgttaaattagttttggttgtgctagcatgaattaataaccaccattttataccagtatcatcagtgaagaattgtatttcaagattcaaacaataaccagcaattaaacttttttctacaatgtatttgtttgcgagtaggacttgggagtcattgggaaaaaaaaataataaattttccccttcattaacgaattcagactcattaaaaacattgccatcaga

SEQ ID NO: 161213 - DNA, 686 bp, Homo sapiens
  Payload ID: 11483
  Gene Symbol: NIFK
  Gene Name: nucleolar protein interacting with the FHA domain of MKI67
  ENST ID: ENST00000423105
  CDS Start-End: 1-309
ctcaggaagaaattagctaaaaaaggaattgactatgattttccttctttggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaaggaaagcagtgtgtaattttggattgcctgcccttggctgaaatacaggggtgcataccatcttgcagtggcttggctgacattgcctctttgtcctggcctctagttttcttttgatatttcatagctctccttagtttactctgcctggatagaaagttgaccactaactgcaggtttaagtactaaactgcagccttttctgtcgccagcaattaaagaccaccaatcttgtttgtccatc

SEQ ID NO: 161214 - DNA, 559 bp, Homo sapiens
  Payload ID: 11483
  Gene Symbol: NIFK
  Gene Name: nucleolar protein interacting with the FHA domain of MKI67
  ENST ID: ENST00000451734
  CDS Start-End: 62-559
ggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaa

SEQ ID NO: 161215 - DNA, 759 bp, Homo sapiens
  Payload ID: 11483
  Gene Symbol: NIFK
  Gene Name: nucleolar protein interacting with the FHA domain of MKI67
  ENST ID: ENST00000447132
  CDS Start-End: 266-759
tacaatgtgattttcttatttatatatttaatttacctggtctttacgtctttagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgt

SEQ ID NO: 161216 - DNA, 6077 bp, Homo sapiens
  Payload ID: 11484
  Gene Symbol: NOM1
  Gene Name: nucleolar protein with MIF4G domain 1
  Uniprot ID: Q5C9Z4
  ENST ID: ENST00000275820
  CDS Start-End: 16-2598
cacgcgtttcgaaagatggcggcgtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagcttggacttaaggatcagcaggagagagaaatcattcacgttctcatggattgctgccttcaagagaaaacttacaatcccttctatgctttcctggctagcaaattctgtgaatatgaaaggagatttcagatgactttccagttcagcatatgggacaaatttcgggacttggaaaacttgccagctacgaatttctctaatttggttcatctggtggcccacttgttgaagacaaaatcgctttccctttccatcttaaaggtagttgaattcagtgaattggacaaacccagagtccgttttttacgaaaagtattaagtatcctattaatggaaacagaagttgaagacctcagtttaattttcacaagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtagaggctgcagtgagccaagattgtaccactgtactccagcctgggctggacagtgagacttttgacagtgagactgtcaaaaaaaaaaaaaaaattaatagataaaacaggccactagagggtgcagttataaagaaattgatgaggtttttacctttttaaaatattggttagaagttcaaaaaccatcccttaaaggtgattgtttttttgagacagagtcttgctctgtcacccagagtggagtgcagtgtcctgtaatctcagctcactgcaacctctacctcccgggttcaagcgattctcctgcctcagcctctttagctgggactacaggcgcacgccaccacgcccggctaatttttgtattttagtagagatgggtttcaccatgttggcaaggctggtcttgaactcctgacctcaggtgatacacccatctcggcctcccaaagtgctgggattacaggcttgagccaccacgcccagcttaaatgtgattcttgatactgttttaagtatttaggttgcaattaactttggcaaagtcagtcgacataagccctgtggatatggccttatgtacactgtaatgcagacaggtgcttttcatcattcatgtaacattctcacacagttgaggatattcatctcctcaccaattccagattgtaaatgtaccatcttaaacaactctgaggtcaccaaacagtagttatttgactgttaataggtgctacttgcttgcaaggatttggagatgtaaacatgaagaaaatatagttactgcctgcaaagaattaacatccgtctagtgggagaaacaaacacaccccactcactaagtatggaaaactgattctgggaggaagcagaaatgtccctagataacagcatgtattgcagatacccaaatgtttattgttttctcagcccttcaattttgcttttctctctcaaatgctacagactcaatttaaatcttacctttgattgttgaaaaaagtcactaagatgtgaatacagaatagacattgagaggttatatatgtccaaaactcatctgtccagcagtcaccgtcctcttcagagtggtcacgttgggcagatgggcacaggtgctggtgatgcctctcctgggcaaaacgccccatttgtggcactttcagatactatttatttactttttaagagagagacaggctcactctgtcacccaggccagagtgcagtggcacgatcatagttaccgcagcatcaaattcctggactgaagcggtccttttgcctcagcctcgcggatagctaggaccacaagcagtagagacaagatctccgtatgttatacaggctggcctcaagtgatcctcttaccttggcctcccaaacaccgggattataggcgtgagcccccgtgcctggcctcaaattttattttagctcgaccctatggcagtttgtgtttggaaatcgtgatgtgaagtcatcagtatctgtgcatatccctaaactaatggtttaagctttgaagcatgcgcaagcaacatgaacaactgaatacagaaagtaactgaaagcagcacagagactgtgtcgtccctacagacttctaaccctgcattcagcaacatcattcgacccgaagccagattcaaaccctatgtcttctagcaggttctgaatttagaggacaaataaggtgacaggtactaagagaagagtgaattaagtgaaaatcttccctttgttaaggagctttttaacaagagtgtctttgctgggtggtgattgggatgtaacagatcagttctactggacttgtagcttgatagtgaaataaggagcttgggctaaggtataaatcaacacactgcttccttcctccagaaggtcttactgtgaaggaaaaaatgtcagttgaactaaattgtgcttcacgcctcggtagatttgcattctgatgcaagcccccaacctcacggaccaagaggatccctggctgcctgtgaatggcccacatttgagtggtgctaacttgatgtgagtaggcattaattatgggtgcggctactaagatgggaaaaactatcacgacagtggcaccacctgatttcatgatgtaccatatgcagtaacccatgtttgaggtacagaattgaagctgatttttctgcaaaagatgaatttctataaacaatcccatttttatattttattattaaaacaaaaatacctctctttgctagagagttatatgtatgacttaaattattagctatggtttgcatttagtacatggcagattgcctgtaagtctgttcattttaacaacatacagggctgggcacggtggctcacgcctgtaatcccagcactttgggaggttgcgggtggatcacttgaggtcaggagttcgagaccagcctggccaacatggcaaaaccccgtctctatgaaaaatataaaaattagctgggcatggtggcaggcacctgtaatcccagctactcgggaggctgaggcaggagaatcgcttgaacctgggaggcggatgttgcagtgagcagagatcgtgccattgcactccagcctgggaacaagagtgaaactctcaaaagcagaaacaaaaacccaacatatatgggctgttagatagtaattgtaatttcgtataaatagtaaatgagtacatcttgattaaaagctatgaattcagaattgcttttaaatatatagggggttttttgaaatttattacagtgcaattgaaaatacacttaaaatactgcaggatgcttagtgctcagtgttatgtatgaacttgtggactttacaatgcaggttgagaactgctaatgtatagaatgactaaacagctgtctttcagggtatcatttttaaaggtataaggaacaaactttaatgtattgaaatgcataaataaaatttattttttatattttgtttaga

SEQ ID NO: 161217 - DNA, 4034 bp, Homo sapiens
  Payload ID: 11485
  Gene Symbol: NCL
  Gene Name: nucleolin
  Uniprot ID: P19338
  ENST ID: ENST00000322723
  CDS Start-End: 242-2374
gattggctcatggggacggccgcgagctttggttggtcggcgcggagtcacgagggcgccgtcgtcgcctttccacaggcgattactgggcaggctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaagagcctgtcaaagaagcacctggaaaacgaaagaaggaaatggccaaacagaaagcagctcctgaagccaagaaacagaaagtggaaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagacgtgttacttcctaaagagtgtttcccctggaatgtcactggagagcatggcaaagccagctctgccacttgcttcacccatcccaatggaaatggcttagtgcgtgtttccagtatcccagccctaactaacttggttgaaatgctggtgaggggacctgctcctgcagccctggtgctgacttgaaggctgctgcagcttctcctacttttagcaggtctgaggattatgtcctgaagaccactctggaaagaggtgcaggaacagattagtcaggtttcctaggacaaggaagagcttcagggaagagcagtggctaactcctgtaatcccaacacttggggaggccgaggcaggcagatcaactgaggtcaggagttgaagaccagcctggccaacatggtgaaagcccatctctactaaaaatacaaaaattagctgggcatggtggtgtactcctgtagtcccagctactcaggaggctgaagcgggagagtcacgtgaacccgggaagcagagtgagctgagcacacactactatactccaggctgggtaacaaagcgagactcccatctcccaaaaagcagttctggaatagaactcacgctagatggatagaccagtggacactttggaaccttggggctggggaggaaactgcccatccagtaaacccccaaaaagccatttgttctgcactacgtatattgcttattctttctggtcttaagtacttgcctctcaacctccctttttagtaaaagacaaggccacgtgagaggcgggactatcaacattgtgatgaatttacttgaaacccagtgcccaaaatcaatgtaggtagccaagtccaaaaacctgttctagtccaactagtgaaatcaaactgtgatacttggataagcttagaaggaaacgtgaagaatacgtagctgctttgggtttactctggttcagttgggctgttgaaatcttaacatccttgggcttatcacctactgcttgtcagccctgttccatgtccaggggatgggggtggtgacaatccagttccaagaccctcatgctctagagaggaaggtggccagccagggttgtaactacgatgaaaaagcagtgggagggtctcctatgaggcaagcctaaggacaaaaaggaaggccttgcagcctgtattctggataaggaattaaaagctcagttaattgaagccca

SEQ ID NO: 161218 - DNA, 890 bp, Homo sapiens
  Payload ID: 11485
  Gene Symbol: NCL
  Gene Name: nucleolin
  ENST ID: ENST00000356936
  CDS Start-End: 1-890
ctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtgatgattctaggaaaacagaccagtcatcagcctatgtaagaacaaccagcaggacattgcaacacgtactaggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggagg

SEQ ID NO: 161219 - DNA, 568 bp, Homo sapiens
  Payload ID: 11485
  Gene Symbol: NCL
  Gene Name: nucleolin
  ENST ID: ENST00000417652
  CDS Start-End: 71-568
agtggggaggtctcgcggcttctggctacttggtggcgaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccct

SEQ ID NO: 161220 - DNA, 562 bp, Homo sapiens
  Payload ID: 11485
  Gene Symbol: NCL
  Gene Name: nucleolin
  ENST ID: ENST00000436894
  CDS Start-End: 139-562
tttttttaagtgccttaatgatcttcaccgttaatttggattcagatgagggtggtagaataaagtaccgggatttgtagtattaaaacacggttgtgcttaactaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgagg

SEQ ID NO: 161221 - DNA, 606 bp, Homo sapiens
  Payload ID: 11485
  Gene Symbol: NCL
  Gene Name: nucleolin
  ENST ID: ENST00000454824
  CDS Start-End: 96-606
gcgcgattagtggggaggtctcgcggcttctggctacttggtggcgaggtgaagagcttctgcaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatg

SEQ ID NO: 161222 - DNA, 964 bp, Homo sapiens
  Payload ID: 11485
  Gene Symbol: NCL
  Gene Name: nucleolin
  ENST ID: ENST00000453992
  CDS Start-End: 511-964
ttctggctacttggtggcgaggtgaagagcttctgcaggtgctgggggcggcgaacgcggcgggaaagacagagtcactgagcgcggggagggggcgctgggcctcggggtggagagatgagaccaaacttttgcgacgcgtacgagctgggactcgactcctgacgcacgtgcccgggagcgcggcctgccacgtgggccgcgccgcgtgggtcctggaatctccagagggaccgggtgccttgggccgggaaatggcggtatcggccctagtcggagtcccggctgcgctcggatgtctccgccccggcctggcaagccgacacgtggtgggccccggaaggtggctctgccgcgtgccttttgcgctgtgtttcgggcacgtggtggcctaccaggtacccccacgtggccgcgccgcctctttaaggggcggggttgtctcgctgggaaaggcataagcttcatgagaaaatcaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaag

SEQ ID NO: 161223 - DNA, 1758 bp, Homo sapiens
  Payload ID: 11486
  Gene Symbol: NPM1
  Gene Name: nucleophosmin (nucleolar phosphoprotein B23, numatrin)
  Uniprot ID: P06748
  ENST ID: ENST00000296930
  CDS Start-End: 302-1186
agtgcgcgtgctcggtgggagcccgcggagtacctggaaggaggtgggggcgaggtagaaaggagtggggttgaaaagcgcttgcgcaggacggctacggtacgggggtgggagggcttcggagcacgcgcgcggaggcgggacttgggaagcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgacttatttaactgctttatactttgtcaaagaaataattaatgtagttaggaatggcaaatagtcttgtaaaattctatgagaatgtccctgccctccccttcaatattctctctggagctaaccactttttcatcataaggatttagtgctgtgttcccacctcctgatgatagttaacaattattataactatgcaacatgtttccaaatgttccattagacctcctatctgccta

SEQ ID NO: 161224 - DNA, 1237 bp, Homo sapiens
  Payload ID: 11486
  Gene Symbol: NPM1
  Gene Name: nucleophosmin (nucleolar phosphoprotein B23, numatrin)
  Uniprot ID: P06748
  ENST ID: ENST00000351986
  CDS Start-End: 121-918
aagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 161225 - DNA, 1598 bp, Homo sapiens
  Payload ID: 11486
  Gene Symbol: NPM1
  Gene Name: nucleophosmin (nucleolar phosphoprotein B23, numatrin)
  Uniprot ID: P06748
  ENST ID: ENST00000393820
  CDS Start-End: 99-878
ttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaagcgcattgaacagtcctgggcactacatgtaaattaagcccaaagatggggagaaaggaaaaggagagacaaatatagtccatactgagtgtcatcaacaatccagactgaagtcttctattttaatctcaatccccttttctgatttgccacccatgcctcttcaggctggaaacaatctcttggttccctaaagcactttcttctgactgctgtgattcagtgaaccttgccctttgctttctattacttgtgcatttgcctcacctgacaatgttttaaatcgcctttgtatctccttagctgctcaataaatatttgaatgcatcaattaagaatgtatgtgacaataattttgaaatggaaattgtgaggtttattttactaggttattggaggcagttaagtttcttaatgctatacctgattctgccaaagtcccttggacatttgaaaaccttttcaatcttttaaaaatgcataaaagatacttagagggaaaggtattaattaaatttagtaaaaacaaatatattcaatgctttaaattccaaagtagtgataaatacaaacatttcaagatatttgcaatagtaatgttttgaaattttggttacaaagtcacaggtcttgccaatactgttgtagtttcttgcctatatccgtaatttgaaggaaatggtgagagtgattagagaagtgtaattactgtaattttttcccctattg

SEQ ID NO: 161226 - DNA, 247 bp, Homo sapiens
  Payload ID: 11486
  Gene Symbol: NPM1
  Gene Name: nucleophosmin (nucleolar phosphoprotein B23, numatrin)
  ENST ID: ENST00000523622
  CDS Start-End: 69-247
gttctctggagcagcgttcttttatctccgtccgccttctctcctacctaagtgcgtgccgccacccgatggaagattcgatggacatggacatgagccccctgaggccccagaactatcttttcgattatcactttaaggtggataatgatgaaaatgagcaccagttatctttaagaacggtcagtttaggggctggtgcaaaggatgagttgcacattgttgaagcagaggcaatgaattacga

SEQ ID NO: 161227 - DNA, 1338 bp, Homo sapiens
  Payload ID: 11486
  Gene Symbol: NPM1
  Gene Name: nucleophosmin (nucleolar phosphoprotein B23, numatrin)
  Uniprot ID: P06748
  ENST ID: ENST00000517671
  CDS Start-End: 136-1020
gggcgatgtccttgctaatttggagactgattcagtccccttttggcccccaagttacgtaaagataaggactttggagatgttttctcaggaaggacagagctgaaaaacaaagttcctgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagt

SEQ ID NO: 161228 - DNA, 597 bp, Homo sapiens
  Payload ID: 11486
  Gene Symbol: NPM1
  Gene Name: nucleophosmin (nucleolar phosphoprotein B23, numatrin)
  ENST ID: ENST00000521672
  CDS Start-End: 263-597
gcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatga

SEQ ID NO: 161229 - DNA, 1100 bp, Homo sapiens
  Payload ID: 11487
  Gene Symbol: NPM2
  Gene Name: nucleophosmin/nucleoplasmin 2
  Uniprot ID: Q86SE8
  ENST ID: ENST00000289820
  CDS Start-End: 241-885
ggggggagctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagga

SEQ ID NO: 161230 - DNA, 925 bp, Homo sapiens
  Payload ID: 11487
  Gene Symbol: NPM2
  Gene Name: nucleophosmin/nucleoplasmin 2
  Uniprot ID: Q86SE8
  ENST ID: ENST00000381530
  CDS Start-End: 233-643
ctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagga

SEQ ID NO: 161231 - DNA, 1874 bp, Homo sapiens
  Payload ID: 11487
  Gene Symbol: NPM2
  Gene Name: nucleophosmin/nucleoplasmin 2
  Uniprot ID: Q86SE8
  ENST ID: ENST00000397940
  CDS Start-End: 1016-1660
agtgtgctccccgccccctgccgcggcgcctcgcctcccggctcacctccccaccccacctgcccgctgcggctctccgcgggagatctcaccgttctggagacagggctcgctcgctctcacggtaggctggaagaacgggctgtctgggccttaggaaaggcccatgctgtataaggcatggggaaaggaaaggaagaaaggcaacgaacaagaaggagggcttccaactgcagcttcctgccggctgcaggcctcccttcctaagctgagctgaggcttcctctccatgggctggggagggggcgccaggaggcctcggcgggtccgcaattggccgggacagcttctcacgaaaggtcctgggccggcatcatcagcctcacctgggaactggttagaactacaaattccctcggccccacccagaccgacgccaagggcagctgtggagtggggcgcggcaatgcgccccttaacagccctccaggcttcttagcccgggcttggacagccgccttccggccagaggggatgaggttgcgctgcgctccgggagcgccgatggcgtgactggccccgcgcggagcagcgacagtaaggctgtgtggggggagctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggaggtgggtactcgtcctccaggagttgccggtgagcccttgaccgtggcaggtcccctccagccgcgagcgacccctcagtacctgccgatgcctgctggtctctggcatcctccagtcgagggtcagggtcagggagcaaggcctcacgcgggcgccctccttgcagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagg

SEQ ID NO: 161232 - DNA, 1190 bp, Homo sapiens
  Payload ID: 11487
  Gene Symbol: NPM2
  Gene Name: nucleophosmin/nucleoplasmin 2
  Uniprot ID: Q86SE8
  ENST ID: ENST00000518119
  CDS Start-End: 331-975
agggggcgccaggaggcctcggcgggtccgcaattggccgggacagcttctcacgaaaggtcctgggccggcatcatcagcctcacctgggaactggttagaactacaaattccctcggccccacccagaccgacgccaagggcagctgtggagtggggcgcggcaatgcgccccttaacagccctccaggcttcttagcccgggcttggacagccgccttccggccagaggggatgaggttgcgctgcgctccgggagcgccgatggcgtgactggccccgcgcggagcagcgacactgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagga

SEQ ID NO: 161233 - DNA, 565 bp, Homo sapiens
  Payload ID: 11487
  Gene Symbol: NPM2
  Gene Name: nucleophosmin/nucleoplasmin 2
  ENST ID: ENST00000522813
  CDS Start-End: 155-565
gtgctccccgccccctgccgcggcgcctcgcctcccggctcacctccccaccccacctgcccgctgcggctctccgcgggagatctcaccgttctggagacagggctcgctcgctctcacgctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggag

SEQ ID NO: 161234 - DNA, 1484 bp, Homo sapiens
  Payload ID: 11487
  Gene Symbol: NPM2
  Gene Name: nucleophosmin/nucleoplasmin 2
  Uniprot ID: Q86SE8
  ENST ID: ENST00000521157
  CDS Start-End: 659-1303
gtgctcctcagtgtgctccccgccccctgccgcggcgcctcgcctcccggctcacctccccaccccacctgcccgctgcggctctccgcgggagatctcaccgttctggagacagggctcgctcgctctcacggcttcttagcccgggcttggacagccgccttccggccagaggggatgaggttgcgctgcgctccgggagcgccgatggcgtgactggccccgcgcggagcagcgacagtaaggctgtgtggggggagctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggaggtgggtactcgtcctccaggagttgccggtgagcccttgaccgtggcaggtcccctccagccgcgagcgacccctcagtacctgccgatgcctgctggtctctggcatcctccagtcgagggtcagggtcagggagcaaggcctcacgcgggcgccctccttgcagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagcccc

SEQ ID NO: 161235 - DNA, 570 bp, Homo sapiens
  Payload ID: 11487
  Gene Symbol: NPM2
  Gene Name: nucleophosmin/nucleoplasmin 2
  ENST ID: ENST00000520125
  CDS Start-End: 274-570
gtgctcctcagtgtgctccccgccccctgccgcggcgcctcgcctcccggctcacctccccaccccacctgcccgctgcggctctccgcgggagatctcaccgttctggagacagggctcgctcgctctcacggcttcttagcccgggcttggacagccgccttccggccagaggggatgaggttgcgctgcgctccgggagcgccgatggcgtgactggccccgcgcggagcagcgacactgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttct

SEQ ID NO: 161236 - DNA, 411 bp, Homo sapiens
  Payload ID: 11487
  Gene Symbol: NPM2
  Gene Name: nucleophosmin/nucleoplasmin 2
  Uniprot ID: Q86SE8
  ENST ID: ENST00000615914
  CDS Start-End: 1-411
atgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaaaaaaaagctggaaaaagaagaagaggaaataagagccagcgttag

SEQ ID NO: 161237 - DNA, 645 bp, Homo sapiens
  Payload ID: 11487
  Gene Symbol: NPM2
  Gene Name: nucleophosmin/nucleoplasmin 2
  Uniprot ID: Q86SE8
  ENST ID: ENST00000621538
  CDS Start-End: 1-645
atgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatga

SEQ ID NO: 161238 - DNA, 877 bp, Homo sapiens
  Payload ID: 11488
  Gene Symbol: NPM3
  Gene Name: nucleophosmin/nucleoplasmin 3
  Uniprot ID: O75607
  ENST ID: ENST00000370110
  CDS Start-End: 24-560
agtttgaagaaggctcttacagcatggccgccggtactgcagctgccttagcgtttttgagtcaggagagccgaacgcgggccgggggtgtcgggggcctacgggtcccggccccggtcactatggacagttttttcttcggctgtgagctctccggccacacccgctccttcacctttaaggtagaggaagaggatgatgcggagcacgtgctggcactaaccatgctctgcctcaccgagggagccaaagacgagtgtaatgtggtagaagttgtggcccggaaccatgaccatcaggagatcgcagtccctgtggccaacctcaagctgtcctgccaacccatgctcagtctggatgacttccagctccaaccacctgtaaccttccgcctgaagtcgggctctggccctgtgcggatcactgggcggcaccagattgttacgatgagcaatgatgtttctgaggaggagagcgaggaagaggaagaggacagtgatgaggaagaagttgagctgtgccccatccttcctgccaaaaagcaggggggcaggccctagccctcctaggtcagctccatgtgccatgcaccgccatgcaccctgttccctgacaagtttcaacaattgtaaatatttcttccttgaagaggagagcttgggtgggggttgggtgggagggacttgggtctttggtgctaggagagggcctgtgctccacacagccgtggttttctgattttcaccatgcccggggcctcccttcccacctgcctgtgagaattggaggttagtgcctgaagctcagagctacacatttttaatagtttttacatttttggataaaggttgaaataaagtggtgtggagtttttgca

SEQ ID NO: 161239 - DNA, 6457 bp, Homo sapiens
  Payload ID: 11489
  Gene Symbol: NUP107
  Gene Name: nucleoporin 107kDa
  Uniprot ID: P57740
  ENST ID: ENST00000229179
  CDS Start-End: 333-3110
tacttcattcttcccagtaggagaacccagggcctgttccacgcccacagactttggtcaggcaaagcggccgcagggcgtctgggctaaacgcaaccaggaacacattggcaaacttttgcgcctgcgcccaccgggcgtgcacctgtaggctgaagtcgcgcatgcgctagatgggaacgttgtttcttctcccctaccccttttctgtgggtctgttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaattccagggttgtctctttttcatgtaataagaaaattaaattttctgttctagttttttctgtaatcataagcattctgatattttaaaatcataaagatgatggaaagtagatttatttttaagccaggtacgtaattttttatttatcataaaatttagtatttttgaatattaaaattaagaagatgactataacaagaatttttctaacataacatgctattattattttagttattttgaagacatttctagtttaactttcatttagcaaacttcctatcaaaataagagcatataaagacttagcgtagtacctggcacacagtaagcactgaatatattggagattacagatcccgctcttctaataggggaaataccataagtacatttaaaaggtgtcatttaaaaatacaagtagtggctgggtgcagtggctcacgtctgtaaccccagcacttcgggaggccgaggcaggtggatcacctgtcgtcaggagtttgagaccagcctggccaacatggtgaaaccctgtctctactaaaaaaatacaaaaattagccgggcatggtggcaggtgcctgtaatcccagctactcaggggaggctgaggcatgagaatctcttgaacctggaaggcagaggttgcagtgagccgagatcacgccactgcactccagccttggggacagagcgagacactgtctccaaaaaaagaaagaattacaagtagtctgagcaggaagaacctctctccagctgaaaagactctcaggaagtagtattggtttggggtttgagtaatgcactgaatttgcaaaggcaaagagtgacacaagaaggatgaggctctatagattaagaaatcagtatgagcaagaaatgataaatgctgggcattattatgaaccaacaaatacaccaaataggctagagtgtagggcttataaacaggagacaactaaaagaatgtgattctaatagaaaacagtaattccccaaacttgctaatcatctaaggaatttcttgaatatgtatttatagatgccacccctagagacagctggcttgggaagcctgagatgggatcatagaatttgatcagttctatattatgtgctttttttgttttatttctctaaagaattcatcttgtcttcctgttttctttattcttactaatatgcaaatgatttttacagctcatgcagtcctgtaatcatgattattgctatgctactttgcaaaaaataaaaacaaaaaattcataccaaaacaaatacagactagatttggggtggggaggggaaataagtgagtcttaaaagtagttttgttacttgcaacaaactgtatatatagaaactttgtacaacccagggtgactatttccaaagactgttacctatttgttgaacaacagtgggaaaactacttagcctaaatgaggaggaggaatattgtatgcttccatcgtaaccgtatgtgggtaaatggacaaggtctgtcatctatttaggaacttgttttgcatgtcccccactctgtatttgtcttttgttgtgccttgttttttgaatgtcctttaaaaaacacagcacagaaacccactaaggttgtggaattacaaaattccttcaaccttagactcttaattaggatgccctcaaatggacttgtttttaatttttatttatttatttatttttgagacatggtcttgctctgtctcccaggccggagtgcagtggcatgatatctcactgcaaacctccgcctcctgggttcaagcgattctcctgcctcagcctccctagtagctgggattacaggcgcctgccaccacgcctggctaatttttgtatttttagtagagacggggttttgccatgttggccaggctggtctcaaactcttgacctcaagtgatccactcgcctcgatctctcaaagtgctgggattacaggcataagccactgcacccagccaattggactcctttgagtccttagggagtcaatgtgtgtgttgctgcttatttaaatacagttcagttggagccccaagagtgccaatgtgctcctcacaattcccaaatgcctctcttcctgaacaccagaagtggtgggcacctgagtgggaaatttcaggcaacttaatttagttcctcagtgcctactcttgaagaactgggttttcattctagagaggaaactcagggaagggcgtgttgcctatcacaggttcgcatactaagttttaaaaacttttcttggtgtgacttatgccaaggaattatgaagactttttccttgagcattgcatgaaggctacaaagttggaacaggcatgtcctgggtgtgaaagttttaatttccctacctcatttatttatttaatttagagatgggggtctcactatgttgcccatcccggcttccaactcctgggctcaagcaatcctcccacgtcagtctctcaaatagctgggactacaggcccacgccaccatgccctacttcctcatttattttaaattttttgtaccacagtctctctttttaattttatgactgctgaattaatcctagactctgtcttaaaactaagaattgatgtattggcaggaacagctggacattcaagatgtttttgtgattccttttttaaaaatctccttttgtacctgtaatatctacaatatataatctttctttatcgacttaaggaggaaggagaaaggaagaacctgacttctgtgtgaaggaccttactgtcgatcaagactgttactcaaagttctatctcttagtcattgcacctgacctgatccaaaacatatatatatatttgtatgcacccctagagacagctgtatatatatacggttttgccaggttgtacgtttttttctcgagttgtaagtgaacacagtagcactcgtttacattgtcaaggggacatctttagagaacacattttctcactgttgagctaataatgctttgtgaatgtatgatctaaggagaaacccttgtagttatacccgatgatgctgtctgttggaaagtaaattttgaatgtctttttccaaaaataaaaaataaaaacatg

SEQ ID NO: 161240 - DNA, 2859 bp, Homo sapiens
  Payload ID: 11489
  Gene Symbol: NUP107
  Gene Name: nucleoporin 107kDa
  Uniprot ID: P57740
  ENST ID: ENST00000378905
  CDS Start-End: 569-2629
gttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaattcc

SEQ ID NO: 161241 - DNA, 678 bp, Homo sapiens
  Payload ID: 11489
  Gene Symbol: NUP107
  Gene Name: nucleoporin 107kDa
  ENST ID: ENST00000538549
  CDS Start-End: 423-678
agcatcagattctgagttccctctatgatctgggtactgtgctagccgcctacaacaaagatcagttattcaagatccttcccctcggggaattagttgtgtaatggagacaaccaagcagtgtaaagtggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtaa

SEQ ID NO: 161242 - DNA, 836 bp, Homo sapiens
  Payload ID: 11489
  Gene Symbol: NUP107
  Gene Name: nucleoporin 107kDa
  ENST ID: ENST00000538993
  CDS Start-End: 1-243
gagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaaggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataat

SEQ ID NO: 161243 - DNA, 3004 bp, Homo sapiens
  Payload ID: 11489
  Gene Symbol: NUP107
  Gene Name: nucleoporin 107kDa
  Uniprot ID: P57740
  ENST ID: ENST00000539906
  CDS Start-End: 245-2935
aagtgccagcatcagattctgagttccctctatgatctgggtactgtgctagccgcctacaacaaagatcagttattcaagatccttcccctcggggaattagttgtgtaatggagacaaccaagcagtgtaaagtggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttgttctttctaccaaccttttgtttatagttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagt

SEQ ID NO: 161244 - DNA, 2655 bp, Homo sapiens
  Payload ID: 11489
  Gene Symbol: NUP107
  Gene Name: nucleoporin 107kDa
  ENST ID: ENST00000535718
  CDS Start-End: 61-372
gctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 161245 - DNA, 5207 bp, Homo sapiens
  Payload ID: 11490
  Gene Symbol: NUP133
  Gene Name: nucleoporin 133kDa
  Uniprot ID: Q8WUM0
  ENST ID: ENST00000261396
  CDS Start-End: 93-3563
ctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagaccta

SEQ ID NO: 161246 - DNA, 5487 bp, Homo sapiens
  Payload ID: 11491
  Gene Symbol: NUP153
  Gene Name: nucleoporin 153kDa
  Uniprot ID: P49790
  ENST ID: ENST00000262077
  CDS Start-End: 1-4428
atggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacat

SEQ ID NO: 161247 - DNA, 6030 bp, Homo sapiens
  Payload ID: 11491
  Gene Symbol: NUP153
  Gene Name: nucleoporin 153kDa
  Uniprot ID: P49790
  ENST ID: ENST00000537253
  CDS Start-End: 448-4968
gggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggagagacaaggtctcaccgtattgcccaagctgatctcgagctcctgcgctcaagcgatcatcccatcttggcctctcaaagtgctgagattacaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatact

SEQ ID NO: 161248 - DNA, 5811 bp, Homo sapiens
  Payload ID: 11491
  Gene Symbol: NUP153
  Gene Name: nucleoporin 153kDa
  Uniprot ID: P49790
  ENST ID: ENST00000613258
  CDS Start-End: 448-4749
gggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcaggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatact

SEQ ID NO: 161249 - DNA, 8143 bp, Homo sapiens
  Payload ID: 11492
  Gene Symbol: NUP155
  Gene Name: nucleoporin 155kDa
  Uniprot ID: O75694
  ENST ID: ENST00000231498
  CDS Start-End: 205-4380
ctcccaacagcttcctcttcccaggccagaacggcgtcttccagttccccaccggatgaagcggaagtgcgtcatgtcgaggcgccaaggcgctcgtttggcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgaggccaagagtttgagaccaacctggccaacatggtgaaaccccatctctactaaaaatacaaaaaaaaatagccaggcgtggtggcgggcgcctgtaatcccagctactcgggaggctgagggaggcgaatcacttgaacccgggaggcagaggtttcagtgagtcaaaatcgcaccattgcactccagcccaggcaacagggcgagactctgtctcaaaaaacaaaaaaacctcaaataggctaagcagatccattcccataatagtggattctaaaaccgtccttaaataggcaaataactgactttttcaaaactttttttaggtgttgggttcacccttgaaagaactgtcctctaacaactggttttgtcagttaaagcccttgagaattgacatagctatatacctggttgagcaggtgataaaacttgtaactaatgttgtgtcctgaaaacctacacagggaggtactgttttcccttagtgtctacctggctgcttggccttgtgactactgattccattagagcagtggttctcaaagtatgtgctccaaaccagaagcatcagcatcagcatcagcatcacctaggaatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtagcccagcctggagtgcagtggtgcgatcccggctcactgcaacctctgcctcacaggtttgaagcaatttgcctgcctcagcctctcgagtagctgggattgcaggtgtgcgccaccatacccagctaatttttgtatttttagtagagatgggtttcaccatgttggccaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaaattctgtcatgtctacttaaaaggaaggccttgtctgaatgttgtaatttaggtgtgactccagttctgctagagataagaacttcatttttgttttaagcacatttacatactagcaatatgttgttatatatactcagctcacaacattgaaagtacatgttttaaaagggctgtaggcttccatggttagatggtctgttagagtcagaaatctgaacactgtccttttattcacacagcatgctttgagaggttttaggaattccagccccacaacagatgcttgcaataccttttggggggtaagattcctaagagagaagaaattaggtcccctcatttttacccttggaacagtgtttctaaaactttcacattcagaacaatcagccggatagcctgttatgacagattcttgagttccatctgtagtgtcatgctgatcctggcagtcagtggatcagagttggagtagcatttatccactgtattagtatactttgtacttggtgtttgttcaacgcattacttttttgaatttttttgttttttgaagacaagggcttgccctggagtgcagtggcatgatcttggctcactgcagcctcgagctcctgggctcaactcagtcttcccacctcatcctcttaaatagctgggactacaggcacgtgctgctacaccctgctattgtctgtttgtttgtttgagactgagttttgctcttgttgcccaggctggagtgcaatggcacaatcttggctcaccacagccttttttatgagactgagttttgctcttgttgcccaggctggagtgcaatggcacgatcttggctcaccacaacctccacttcctgggttcaagcaattcttctgcctcagcctcccgagtagctgagattacaggcatgcgccaccatgcctggctaattttttttttttgtatttttagtagagatggggtttcaccgtgttggtcaggctggtcttgaactcctgacctcaggtgatccaccccccttggcctcccaaagagctgggattacaggcatgagccactgcgcctagccccaccccccctactttttttttttttttttttttaattttttgtgtagccaaaagatctcactctgttgcccagactgctctcaaaactcctggccttaagtgattcccctgcctcagtctcccaaagtgctgggattataggcatgagccaccatgcctgtccattatttctttatagtgactattatatgtaggcaatgtataattggtagaacatagtctatgaaacagtgcgttaattgtgggcagtgaagaatcattgaagttgtgaaatttgtattttaactagatcattgtagtatggcaaaacggttaggaaagagaaagctatcttgactaactgtttatgctatgagatactgactgatgtacatgtacatttagtgtttctttaggtatacctgacttattcattgaacacctatccactgatctcaaaagtattcctcagggtagtctccattcctgtcatttttcctcctattcatgagacggaaaaattatgaccatggtacagagttgtatcaaggaaatgaagaactagaacattgaattgaaaggttttgaaagggttcacaatttcttttcattttctattaatgtcttcttttaaattctcttaagaataaaacttttttctaata

SEQ ID NO: 161250 - DNA, 4200 bp, Homo sapiens
  Payload ID: 11492
  Gene Symbol: NUP155
  Gene Name: nucleoporin 155kDa
  Uniprot ID: O75694
  ENST ID: ENST00000381843
  CDS Start-End: 141-4139
gactctcgcctgacttcctaatttgctacttatccccagcgttggtcccggcgaggatatgctgagatttatggcactgttggctgcatttttggagaacagcaagcagcttcttttcagataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 161251 - DNA, 4088 bp, Homo sapiens
  Payload ID: 11492
  Gene Symbol: NUP155
  Gene Name: nucleoporin 155kDa
  ENST ID: ENST00000513532
  CDS Start-End: 105-4088
gcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaa

SEQ ID NO: 161252 - DNA, 673 bp, Homo sapiens
  Payload ID: 11492
  Gene Symbol: NUP155
  Gene Name: nucleoporin 155kDa
  ENST ID: ENST00000507675
  CDS Start-End: 127-291
gaggcgccaaggcgctcgtttggcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaagtgagtgatagtgaccctgctttctcaacctaaaggactctcgcctgacttcctaatttgctacttatccccagcgttggtcccggcgaggatatgctgagatttatggcactgttggctgcatttttggagaacagcaagcagcttcttttcagataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatgg

SEQ ID NO: 161253 - DNA, 5376 bp, Homo sapiens
  Payload ID: 11493
  Gene Symbol: NUP160
  Gene Name: nucleoporin 160kDa
  Uniprot ID: Q12769
  ENST ID: ENST00000378460
  CDS Start-End: 48-4358
gtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggacatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaagaaggttgatgctgctgaattgcttcgtttatacttaaactatgaccttttagaagaagctgtggatttggtgtcagaatatgtggatgctgtattgggaaaaggacatcaatacttcggaattgagtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtggtactgttgttgata

SEQ ID NO: 161254 - DNA, 1537 bp, Homo sapiens
  Payload ID: 11493
  Gene Symbol: NUP160
  Gene Name: nucleoporin 160kDa
  Uniprot ID: Q12769
  ENST ID: ENST00000526870
  CDS Start-End: 136-810
ccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtaagaatgggaactgagcatggatttaactttaaacaaggaatgttaacattgaaacagttcaacctcgtcatccaatgcagggattgcatctctactgccccggaactggtcattcattattgcttgcctaatgagtccctaatgctttacttttatacagtggataaggaactataaagcatattggagcacggaaaaacaaatagacaagtataagacagcctattctaaatcttgtagtagagatgggttgcctaattgtctgccctgagatggaggcattataacattataattaaattaattgaaacaaagacattaaataccctgcaccaagtt

SEQ ID NO: 161255 - DNA, 4138 bp, Homo sapiens
  Payload ID: 11493
  Gene Symbol: NUP160
  Gene Name: nucleoporin 160kDa
  ENST ID: ENST00000528071
  CDS Start-End: 1-3370
cggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggacatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtggtatgaaaacatttcatcctggaatttgggggttcatcctggaacaagtaaatctacttgttttggtcctttcaaaactattgtgtcattttgcttcttttgatttacaatttctactgagatatttgtgaaaaaaatctatgtttacaattcaattgttgtatattactacccctttagttttcaagttcagaattattgtaggaagaaatattgcagagtggttttggagttagacctgacccaattcagacaagttacttaatcttttgtcattctctggcataaaatacggataatatctactttataggattgtttgggtattaatgagataattcaagtcgattgcttagaacagtaacagtgcctggcccacaaactgtgctcagtaaatggtagctgcttttatttctattgtgtttgttaatgcagtctacagttactgttttaaaggacacacactttgagtttttcctatcatactgatgggtcagatacatgcagctgtttctgttatatataactctggagccgagaaaaattagttgatttacatggagatcaaatccctgtccttggactcagtaatatgttatggttaagttaacaacttggcaaagaacttctttctttgtctcatagttacagtacctctgtaagaagagctctgctggtcgaaacaaaaataatttccattgagaaaatttaagcataaaagctatgaatcaccgttaatgatatcagaataaaatactgattttcacagttaaa

SEQ ID NO: 161256 - DNA, 4811 bp, Homo sapiens
  Payload ID: 11493
  Gene Symbol: NUP160
  Gene Name: nucleoporin 160kDa
  ENST ID: ENST00000530326
  CDS Start-End: 1-3943
ggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggacatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatctttt

SEQ ID NO: 161257 - DNA, 1961 bp, Homo sapiens
  Payload ID: 11493
  Gene Symbol: NUP160
  Gene Name: nucleoporin 160kDa
  ENST ID: ENST00000528501
  CDS Start-End: 1-309
gacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagagacggggtttcgccatgttgcctggtctcaaactcctgagttcaagcagtccacccacctcggcttcccaatgtgctgggattacaagtgtgaaccacagcacccagcctgaatttttcttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggacatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccaggtaaatgacagaacaacaaatgtgcctctttgattaaaacaatgatgcattcaactccatttttcttctttttacagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctact

SEQ ID NO: 161258 - DNA, 5689 bp, Homo sapiens
  Payload ID: 11494
  Gene Symbol: NUP188
  Gene Name: nucleoporin 188kDa
  Uniprot ID: Q5SRE5
  ENST ID: ENST00000372577
  CDS Start-End: 22-5271
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 161259 - DNA, 6266 bp, Homo sapiens
  Payload ID: 11495
  Gene Symbol: NUP205
  Gene Name: nucleoporin 205kDa
  Uniprot ID: Q92621
  ENST ID: ENST00000285968
  CDS Start-End: 27-6065
aagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcactctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaaggaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaacaaa

SEQ ID NO: 161260 - DNA, 1800 bp, Homo sapiens
  Payload ID: 11495
  Gene Symbol: NUP205
  Gene Name: nucleoporin 205kDa
  ENST ID: ENST00000477620
  CDS Start-End: 1-821
ctcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctgcattctacattttataggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagta

SEQ ID NO: 161261 - DNA, 570 bp, Homo sapiens
  Payload ID: 11495
  Gene Symbol: NUP205
  Gene Name: nucleoporin 205kDa
  ENST ID: ENST00000463247
  CDS Start-End: 1-215
ttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccagagacagagtttcaccatgttgagcagactggtctcaaactcctgacctcaagtaatctgcccacctcagcctcccaaagtgttgggaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttc

SEQ ID NO: 161262 - DNA, 553 bp, Homo sapiens
  Payload ID: 11495
  Gene Symbol: NUP205
  Gene Name: nucleoporin 205kDa
  ENST ID: ENST00000472132
  CDS Start-End: 1-553
taagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcg

SEQ ID NO: 161263 - DNA, 653 bp, Homo sapiens
  Payload ID: 11495
  Gene Symbol: NUP205
  Gene Name: nucleoporin 205kDa
  ENST ID: ENST00000490439
  CDS Start-End: 1-128
gtcagtctgtgatgcctgctggtgttgataaaatctccactgctcagaaatatgttctagcaagacggcgcttggtgaaggtgatcaacaatcgagctaaactgctttccctttgttcttggggctgatccagctctagaagaatggaggaggtctgctattatgctgattcttattgctggagtgggcctctgtgactgatggccatatattggatcccttaggtggaaggaaatagagaaaagctgagaaccctgattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaa

SEQ ID NO: 161264 - DNA, 7193 bp, Homo sapiens
  Payload ID: 11496
  Gene Symbol: NUP210
  Gene Name: nucleoporin 210kDa
  Uniprot ID: Q8TEM1
  ENST ID: ENST00000254508
  CDS Start-End: 84-5747
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaacccccggctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtggtggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 161265 - DNA, 5424 bp, Homo sapiens
  Payload ID: 11497
  Gene Symbol: NUP210L
  Gene Name: nucleoporin 210kDa-like
  Uniprot ID: Q5VU65
  ENST ID: ENST00000271854
  CDS Start-End: 73-5283
acgcctgtggattggctgatggagctgtgagccggctgtagttgagcgggaacccgagacctggcagtcgccatgactggctgtccggcgtcatcaagacgccgaggcttcgggctctttttcttcttgcgtctacaccgcctcctgttgttgtttctggttttgcgtgggaccctggccaacaaacttaacgtgccacaggtgttgctacccttcggccgagagccaggccgggtgcctttcctgctggaggcccagcggggctgctacacttggcattccacccatcatgatgcagttactgttgagcctttatatgaaaatggcaccttgtgttcccaaaaagctgtactcattgctgaatctacgcaaccgatacgcctcagcagtattattcttgctcgagaaatagtgactgaccatgagctacgctgtgatgttaaggttgatgtgataaacagcattgaaattgtatctcgggcccgggaactttatgtagatgattcgccactggaactgatggtgagggcattggatgctgaaggaaatacttttagtagtttggcagggatgatgtttgagtggagcattgcccaggacaacgagtcagcaagagaagaactgtctagcaaaattaggattcttaaatactccgaagcagaatatgctcccccaatatatatagctgagatggaaaaagaggagaaacaaggagatgtgattttagtgtctgggattagaactggtgctgctgttgtaaaagttcgaattcatgaaccattctataagaaagtggcagcagccttaatacgtctgcttgttttggagaatatatttcttataccatcccatgatatttatctcttagtaggaacatatattaaataccaagttgcaaaaatggttcaagggagagtgacagaggtgaaatttcccctggaacattatatactggaattgcaagaccatagagttgcacttaacgggtctcattctgagaaagtggctatactggatgacaaaacagccatggtgactgcctcacaactgggccagactaatcttgtctttgtccataaaaatgttcatatgcgatctgtgtctggactcccaaattgcaccatatatgttgtagagcctggatttttaggtttcactgtccaacctggaaaccgatggagtctagaggtgggacaggtatatgtcattacagtagacgtctttgataaaagcagcacaaaggtctatatttcagataatctcaggattacatacgactttcctaaggagtactttgaagagcaactaactaccgtgaatggatcttaccatatagtaaaagccctgaaagatggtgttgtggtaataaatgcatccctgacctccatcatttaccagaataaagatattcagcctataaaatttctaatcaaacaccaacaagaagtgaagatttattttcccatcatgcttacacccaaatttctggcatttcctcatcatcctatgggaatgttatatcgttataaagtacaggtagagggtggcagtggcaactttacctggacttcttctaatgaaacagtggtcatagtaaccacgaaaggagtggtgactgcaggtcaggtcagggggaatagtactgttttggcccgagatgtacaaaatccctttcgatatggagaaattaagatacatgtcctgaaactgaacaaaatggaactgttaccatttcatgctgatgtggagattggccagattatagaaatacccattgcaatgtatcacataaataaagagaccaaagaagccatggcattcacagactgctctcatttatccttggatctgaacatggataaacaaggagtctttactcttctcaaagaaggtattcaaagacctggaccaatgcattgttccagtacacatatcgcagctaaatctcttggccatactctggtaacagtaagtgtgaatgaatgtgacaagtacttggagagcagtgctacatttgctgcttatgaacccctaaaggctttaaatcctgtggaagtggcattggtgacatggcagtctgtgaaggaaatggtatttgaagggggtcctcgtccatggatcttggagccctcccgattttttttggaattgaatgcggagaagacagagaagattggaatagcacaagtgtggctgccatctaagagaaaacagaaccagtacatctaccggatccaatgcctggatttaggggaacaagttctcacattccgaattggaaatcatccaggtgtcctgaaccctagtccagctgtagaggttttgcaggttcgcttcatttgtgcccaccctgccagtatgtcagtaactccagtatacaaggtgccagctggtgcccagccatgtcctctgccacagcacaacaaatggctgattcctgtatcaagactgagggacacagtcctggaactagcagtgtttgatcaacataggagaaagtttgataatttcagttcactaatgctagaatggaaatcctccaatgaaacactagcccatttcgaagattataaatcagtggaaatggtagcaaaagatgatggcagtgggcagacccggttacatggtcatcagatccttaaagtacatcagataaaagggactgtactgattggagtcaattttgtgggctattcagagaagaaaagcccaaaagaaatttccaacttgcccagatctgtagatgtggaactgctcctggtagatgatgtaactgtagtgcctgagaatgccaccatctataaccaccctgatgtaaaggaaacatttagccttgtggaaggatctggttattttttagtcaacagcagtgagcagggtgttgtcaccatcacttacatggaagcagaaagctctgttgagttagttccattacatcctggattttttaccttggaggtctatgatctttgtttggctttcttgggtccagcaacagcccacctcagggtgtcagacatacaagagctggagcttgatctgattgataaggttgaaatagacaaaactgtgttagtgactgtgagggttcttggctcttccaaacgcccattccaaaataaatacttcagaaacatggaactcaaactgcagttggcttctgccattgtcaccctgacaccaatggagcaacaggacgaatactctgaaaattatattcttcgagctaccactattgggcaaaccacacttgtggctattgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccctttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttctt

SEQ ID NO: 161266 - DNA, 2168 bp, Homo sapiens
  Payload ID: 11497
  Gene Symbol: NUP210L
  Gene Name: nucleoporin 210kDa-like
  ENST ID: ENST00000368553
  CDS Start-End: 14-2023
tgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccctttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaa

SEQ ID NO: 161267 - DNA, 5889 bp, Homo sapiens
  Payload ID: 11497
  Gene Symbol: NUP210L
  Gene Name: nucleoporin 210kDa-like
  Uniprot ID: Q5VU65
  ENST ID: ENST00000368559
  CDS Start-End: 73-5739
acgcctgtggattggctgatggagctgtgagccggctgtagttgagcgggaacccgagacctggcagtcgccatgactggctgtccggcgtcatcaagacgccgaggcttcgggctctttttcttcttgcgtctacaccgcctcctgttgttgtttctggttttgcgtgggaccctggccaacaaacttaacgtgccacaggtgttgctacccttcggccgagagccaggccgggtgcctttcctgctggaggcccagcggggctgctacacttggcattccacccatcatgatgcagttactgttgagcctttatatgaaaatggcaccttgtgttcccaaaaagctgtactcattgctgaatctacgcaaccgatacgcctcagcagtattattcttgctcgagaaatagtgactgaccatgagctacgctgtgatgttaaggttgatgtgataaacagcattgaaattgtatctcgggcccgggaactttatgtagatgattcgccactggaactgatggtgagggcattggatgctgaaggaaatacttttagtagtttggcagggatgatgtttgagtggagcattgcccaggacaacgagtcagcaagagaagaactgtctagcaaaattaggattcttaaatactccgaagcagaatatgctcccccaatatatatagctgagatggaaaaagaggagaaacaaggagatgtgattttagtgtctgggattagaactggtgctgctgttgtaaaagttcgaattcatgaaccattctataagaaagtggcagcagccttaatacgtctgcttgttttggagaatatatttcttataccatcccatgatatttatctcttagtaggaacatatattaaataccaagttgcaaaaatggttcaagggagagtgacagaggtgaaatttcccctggaacattatatactggaattgcaagaccatagagttgcacttaacgggtctcattctgagaaagtggctatactggatgacaaaacagccatggtgactgcctcacaactgggccagactaatcttgtctttgtccataaaaatgttcatatgcgatctgtgtctggactcccaaattgcaccatatatgttgtagagcctggatttttaggtttcactgtccaacctggaaaccgatggagtctagaggtgggacaggtatatgtcattacagtagacgtctttgataaaagcagcacaaaggtctatatttcagataatctcaggattacatacgactttcctaaggagtactttgaagagcaactaactaccgtgaatggatcttaccatatagtaaaagccctgaaagatggtgttgtggtaataaatgcatccctgacctccatcatttaccagaataaagatattcagcctataaaatttctaatcaaacaccaacaagaagtgaagatttattttcccatcatgcttacacccaaatttctggcatttcctcatcatcctatgggaatgttatatcgttataaagtacaggtagagggtggcagtggcaactttacctggacttcttctaatgaaacagtggtcatagtaaccacgaaaggagtggtgactgcaggtcaggtcagggggaatagtactgttttggcccgagatgtacaaaatccctttcgatatggagaaattaagatacatgtcctgaaactgaacaaaatggaactgttaccatttcatgctgatgtggagattggccagattatagaaatacccattgcaatgtatcacataaataaagagaccaaagaagccatggcattcacagactgctctcatttatccttggatctgaacatggataaacaaggagtctttactcttctcaaagaaggtattcaaagacctggaccaatgcattgttccagtacacatatcgcagctaaatctcttggccatactctggtaacagtaagtgtgaatgaatgtgacaagtacttggagagcagtgctacatttgctgcttatgaacccctaaaggctttaaatcctgtggaagtggcattggtgacatggcagtctgtgaaggaaatggtatttgaagggggtcctcgtccatggatcttggagccctcccgattttttttggaattgaatgcggagaagacagagaagattggaatagcacaagtgtggctgccatctaagagaaaacagaaccagtacatctaccggatccaatgcctggatttaggggaacaagttctcacattccgaattggaaatcatccaggtgtcctgaaccctagtccagctgtagaggttttgcaggttcgcttcatttgtgcccaccctgccagtatgtcagtaactccagtatacaaggtgccagctggtgcccagccatgtcctctgccacagcacaacaaatggctgattcctgtatcaagactgagggacacagtcctggaactagcagtgtttgatcaacataggagaaagtttgataatttcagttcactaatgctagaatggaaatcctccaatgaaacactagcccatttcgaagattataaatcagtggaaatggtagcaaaagatgatggcagtgggcagacccggttacatggtcatcagatccttaaagtacatcagataaaagggactgtactgattggagtcaattttgtgggctattcagagaagaaaagcccaaaagaaatttccaacttgcccagatctgtagatgtggaactgctcctggtagatgatgtaactgtagtgcctgagaatgccaccatctataaccaccctgatgtaaaggaaacatttagccttgtggaaggatctggttattttttagtcaacagcagtgagcagggtgttgtcaccatcacttacatggaagcagaaagctctgttgagttagttccattacatcctggattttttaccttggaggtctatgatctttgtttggctttcttgggtccagcaacagcccacctcagggtgtcagacatacaagagctggagcttgatctgattgataaggttgaaatagacaaaactgtgttagtgactgtgagggttcttggctcttccaaacgcccattccaaaataaatacttcagaaacatggaactcaaactgcagttggcttctgccattgtcaccctgacaccaatggagcaacaggacgaatactctgaaaattatattcttcgagctaccactattgggcaaaccacacttgtggctattgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccctttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaaggggtttatgtctgcataatcaaggttcgaccgcagtcagaggagctgctacaggccctcagtgtggctgacacctcagtctatgggtgggctacactggtcagtgaacgtagcaagaatggaatgcaacgaatcctcattcctttcatcccagccttttatattaaccagtcagaattggttcttagccacaaacaagatatcggggagataagagtactgggagtggacagagttcttaggaagctagaggtcatctccagctccccagttctagtggtcgctggccatagccactctcccctcactcctggcctggccatttactctgtaagagtggtcaacttcacttccttccagcaaatggcatcacctgttttcatcaatatttcctgtgtactcaccagtcaaagtgaggcagtggtagtgagggctatgaaagataagttgggtgcagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaactggt

SEQ ID NO: 161268 - DNA, 7600 bp, Homo sapiens
  Payload ID: 11498
  Gene Symbol: NUP214
  Gene Name: nucleoporin 214kDa
  Uniprot ID: P35658
  ENST ID: ENST00000359428
  CDS Start-End: 145-6417
cgtcaccaaagcgcgccggaaatgcgaggtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacagaacgtatgtgggttttttcagatcacagccaagaagattgccccgtttctgtggctctgagaagccagcagagcctccatcagccagaacactgtgtcttcaaggatggcatcagaagtcaccagcgtcgggtgttgataaacagcatcgaatgtgccgtggtctcacttggacctagcgccctccacatagggaagaggttgaatgctggtgggtcatctttttgaggctgaaacttggttatctcctctccttgttcttttagccattgtgtatcaggaccatccaaggacgcactctgcgattgagtggaggcagaggaagccactcatgccagcagcagttgagtttcagaagcagccatagcgcttttcagtacagtacaatagtagccagcgtgaggcaggacagtgctgcgccttagccggccttggctctcatctccatgtggctcttgggtgccatgtgtcctactccagagaggagggggccggtcacttgagaagacagcctttatattctgtatgtggcagtgacattggtagccacacctacccagtgtctactaaccacagtgcagatagcccttgggtagacccaggaagtgtgaagacagacactgctgttgccagacaacactagcagaacgatgctggatttgacaacagtgtttgctaggacggcccagagctcatcactgcagttttattagagtgcttctttatctttaatgcagtatctttgaggcctgtaacatcctagatagttgccatcaaacaaggaccgtctcgcattgaaaacagatgtaagaatttctctttcaggcccagaatctgacagtgctttggcttgggtcatgagcagcggggagttgggaagagatttttttttttagagttttacatattggcaggttgtatttttttaatgttttaataaaagtttgacatgacattaattcatca

SEQ ID NO: 161269 - DNA, 7538 bp, Homo sapiens
  Payload ID: 11498
  Gene Symbol: NUP214
  Gene Name: nucleoporin 214kDa
  Uniprot ID: P35658
  ENST ID: ENST00000411637
  CDS Start-End: 120-6362
gaggtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaatagctcccagagcgcacccccgatgtcgccattctcttctgcctccaagccagctgcttctggaccactcagccaccccacacctctctcagcaccacctagttccgtgccattgaagtcctcagtcttgccctcaccatcagcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacagaacgtatgtgggttttttcagatcacagccaagaagattgccccgtttctgtggctctgagaagccagcagagcctccatcagccagaacactgtgtcttcaaggatggcatcagaagtcaccagcgtcgggtgttgataaacagcatcgaatgtgccgtggtctcacttggacctagcgccctccacatagggaagaggttgaatgctggtgggtcatctttttgaggctgaaacttggttatctcctctccttgttcttttagccattgtgtatcaggaccatccaaggacgcactctgcgattgagtggaggcagaggaagccactcatgccagcagcagttgagtttcagaagcagccatagcgcttttcagtacagtacaatagtagccagcgtgaggcaggacagtgctgcgccttagccggccttggctctcatctccatgtggctcttgggtgccatgtgtcctactccagagaggagggggccggtcacttgagaagacagcctttatattctgtatgtggcagtgacattggtagccacacctacccagtgtctactaaccacagtgcagatagcccttgggtagacccaggaagtgtgaagacagacactgctgttgccagacaacactagcagaacgatgctggatttgacaacagtgtttgctaggacggcccagagctcatcactgcagttttattagagtgcttctttatctttaatgcagtatctttgaggcctgtaacatcctagatagttgccatcaaacaaggaccgtctcgcattgaaaacagatgtaagaatttctctttcaggcccagaatctgacagtgctttggcttgggtcatgagcagcggggagttgggaagagatttttttttttagagttttacatattggcaggttgtatttttttaatgttttaataaaagtttgacatgacattaa

SEQ ID NO: 161270 - DNA, 5021 bp, Homo sapiens
  Payload ID: 11498
  Gene Symbol: NUP214
  Gene Name: nucleoporin 214kDa
  ENST ID: ENST00000451030
  CDS Start-End: 248-4807
gtgccaggcactgtggtagtcatcgcggcagccctacgaagtagtcgttaacgtagaggagtaagttgaggctcggaaagtaatttccctaaagtcacatttgacgcggggctgaaagccagcatcatttaagacctttgcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 161271 - DNA, 3208 bp, Homo sapiens
  Payload ID: 11498
  Gene Symbol: NUP214
  Gene Name: nucleoporin 214kDa
  ENST ID: ENST00000453861
  CDS Start-End: 1-2903
ccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtccctggccatgagcctgtctccgaccctgaagggcaggctgttgctgatgaggcccaaggcaggaggaggaagggagcaggccgctcctgggagaaagtccaatgagagcagatcccttggccacctttgtatggaaagagccttgacctcaccattaaaagtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 161272 - DNA, 502 bp, Homo sapiens
  Payload ID: 11498
  Gene Symbol: NUP214
  Gene Name: nucleoporin 214kDa
  ENST ID: ENST00000476004
  CDS Start-End: 1-436
aggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggaggtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacagaa

SEQ ID NO: 161273 - DNA, 393 bp, Homo sapiens
  Payload ID: 11498
  Gene Symbol: NUP214
  Gene Name: nucleoporin 214kDa
  ENST ID: ENST00000528406
  CDS Start-End: 1-237
ggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtaca

SEQ ID NO: 161274 - DNA, 560 bp, Homo sapiens
  Payload ID: 11498
  Gene Symbol: NUP214
  Gene Name: nucleoporin 214kDa
  ENST ID: ENST00000530863
  CDS Start-End: 1-560
tgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccat

SEQ ID NO: 161275 - DNA, 1775 bp, Homo sapiens
  Payload ID: 11498
  Gene Symbol: NUP214
  Gene Name: nucleoporin 214kDa
  ENST ID: ENST00000531600
  CDS Start-End: 291-1775
agttggtatcatgtacgcctcacatgagaaggaggtatctagcacttctcgaccggggcctaaagctttatgttaaaaggaaaattatatagtagaactgtcaaagacttgagtattttacaaaaaggttttgaaagatcatatactcttttttcaaggacttcattggagaggtttttgtcactcttggagttagaatcaaagaaacctaaggaactttgctttatgcatgtctgggcaagtagtgtgacttgcaagaaatttccgagattcaccattcattgctgatcatgaaatcctctcttttgttacgaggtgttcacttctgttttcacttgccaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagcccca

SEQ ID NO: 161276 - DNA, 483 bp, Homo sapiens
  Payload ID: 11498
  Gene Symbol: NUP214
  Gene Name: nucleoporin 214kDa
  ENST ID: ENST00000498010
  CDS Start-End: 1-342
ctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtaagtatccccctttttgagtctcaccttaattaaaagcattaaataaggttggaagtgtgtggatcttgctggatttgtgcattttcttttcgttttttcctgtttttagagtttgtcctggaagtgtgggggttcagcagcagggtttgggttttgtg

SEQ ID NO: 161277 - DNA, 545 bp, Homo sapiens
  Payload ID: 11498
  Gene Symbol: NUP214
  Gene Name: nucleoporin 214kDa
  ENST ID: ENST00000531584
  CDS Start-End: 390-545
gttaacgtagaggagtaagttgaggctcggaaagtaatttccctaaagtcacatttgacgcggggctgaaagccagcatcatttaagacctttgctctcccagtacttctgtaagaatgagggtacaacagacgggctacatctgttttaaatagtgaaaagaagattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcat

SEQ ID NO: 161278 - DNA, 3275 bp, Homo sapiens
  Payload ID: 11498
  Gene Symbol: NUP214
  Gene Name: nucleoporin 214kDa
  ENST ID: ENST00000483497
  CDS Start-End: 309-3059
ggagtgatatggaaccacagttggtatcatgtacgcctcacatgagaaggaggtatctagcacttctcgaccggggcctaaagctttatgttaaaaggaaaattatatagtagaactgtcaaagacttgagtattttacaaaaaggttttgaaagatcatatactcttttttcaaggacttcattggagaggtttttgtcactcttggagttagaatcaaagaaacctaaggaactttgctttatgcatgtctgggcaagtagtgtgacttgcaagaaatttccgagattcaccattcattgctgatcatgaaatcctctcttttgttacgaggtgttcacttctgttttcacttgccagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtac

SEQ ID NO: 161279 - DNA, 577 bp, Homo sapiens
  Payload ID: 11498
  Gene Symbol: NUP214
  Gene Name: nucleoporin 214kDa
  ENST ID: ENST00000526346
  CDS Start-End: 1-423
tgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatggggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagg

SEQ ID NO: 161280 - DNA, 1633 bp, Homo sapiens
  Payload ID: 11499
  Gene Symbol: NUP35
  Gene Name: nucleoporin 35kDa
  Uniprot ID: Q8NFH5
  ENST ID: ENST00000295119
  CDS Start-End: 104-1084
acgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgata

SEQ ID NO: 161281 - DNA, 998 bp, Homo sapiens
  Payload ID: 11499
  Gene Symbol: NUP35
  Gene Name: nucleoporin 35kDa
  ENST ID: ENST00000374930
  CDS Start-End: 47-505
aaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacaggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttc

SEQ ID NO: 161282 - DNA, 1470 bp, Homo sapiens
  Payload ID: 11499
  Gene Symbol: NUP35
  Gene Name: nucleoporin 35kDa
  Uniprot ID: Q8NFH5
  ENST ID: ENST00000409798
  CDS Start-End: 234-1163
acaccaggtgctgaaggctgagacggtgagagcatgagtgataagatgctctctccccttgctctctttctgaagatgacaaactccatcttttttctaaagtcttactaaaggtgacaatgtatatagtataatgaaggatgttactaaatgacatgtgctgcacacctgagtcttgtggaggctgaagaaaaggaggcttctgtagaaaataggaactcagatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgag

SEQ ID NO: 161283 - DNA, 342 bp, Homo sapiens
  Payload ID: 11499
  Gene Symbol: NUP35
  Gene Name: nucleoporin 35kDa
  ENST ID: ENST00000455063
  CDS Start-End: 183-342
ggtgagagcatgagtgataagatgctctctccccttgctctctttctgaagatgacaaactccatcttttttctaaagtcttactaaagtttaacaagaaataaaaaaagtacaaatgtttctcattcaagataatccacattttgaagatctcattttacacaaaaaagggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcag

SEQ ID NO: 161284 - DNA, 616 bp, Homo sapiens
  Payload ID: 11499
  Gene Symbol: NUP35
  Gene Name: nucleoporin 35kDa
  ENST ID: ENST00000442895
  CDS Start-End: 387-616
tacaccaggtgctgaaggctgagacggtgagagcatgagtgataagatgctctctccccttgctctctttctgaagatgacaaactccatcttttttctaaagtcttactaaagtggtgggaatccaaattacacagcaccaaaatatgttgtcagcggcaaatccatacgggtctgcaacaacaattcttgtgtcctcaggagagaatctgactaaggggcataaggcagaagagaccaagacaagttttagagcaggagtgaaggtgacaatgtatatagtataatgaaggatgttactaaatgacatgtgctgcacacctgagtcttgtggaggctgaagaaaaggaggcttctgtagaaaataggaactcagatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtat

SEQ ID NO: 161285 - DNA, 755 bp, Homo sapiens
  Payload ID: 11499
  Gene Symbol: NUP35
  Gene Name: nucleoporin 35kDa
  ENST ID: ENST00000452137
  CDS Start-End: 1-411
atggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagggtccccaacagggtcctgatcagttgcccaggctagagtgcagcggcacagtcataactctgcagccttgaactcctgggttcaaccaatcctcctgcctcaactgtcctattgggatataggcacgtgctgctatgcctggctaattgtatttttttttgtagagatgaggtcttgccggattcaggtgatccttgcaccttgacctctcaaagcgctagattataaatgtgagccactgtgcctggccgacttttcttttaagtagaaaatttagtagcttcatagacacaagtgttgtttcctattattattgtgcttagtaggacatataaacaaagtttatcagttaagttgccaaacatttcagtaatgcagagtcctcttgttggagttacatctactcctggaacag

SEQ ID NO: 161286 - DNA, 470 bp, Homo sapiens
  Payload ID: 11499
  Gene Symbol: NUP35
  Gene Name: nucleoporin 35kDa
  ENST ID: ENST00000446612
  CDS Start-End: 125-470
acaccaggtgctgaaggctgagacggtgagagcatgagtgataagatgctctctccccttgctctctttctgaagatgacaaactccatcttttttctaaagtcttactaaaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacag

SEQ ID NO: 161287 - DNA, 1203 bp, Homo sapiens
  Payload ID: 11500
  Gene Symbol: NUP37
  Gene Name: nucleoporin 37kDa
  Uniprot ID: Q8NFH4
  ENST ID: ENST00000251074
  CDS Start-End: 66-1046
tttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttg

SEQ ID NO: 161288 - DNA, 798 bp, Homo sapiens
  Payload ID: 11500
  Gene Symbol: NUP37
  Gene Name: nucleoporin 37kDa
  ENST ID: ENST00000547269
  CDS Start-End: 1-96
atttggaacttggaaggagtgcaaacagctcattttgttcttcattctcctggcatgagtgtgtgctggcatcctgaggagacttttaagatatgaaagataactccaggtcactcaacaggtttaaatggtacagctcaggagttttgatgccaaatcccacattcttgccaatctaccactactatttacaccctcaaggatttttcaacttaatagaaccagaattaaaagaacactgcttaaaactaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatact

SEQ ID NO: 161289 - DNA, 2372 bp, Homo sapiens
  Payload ID: 11500
  Gene Symbol: NUP37
  Gene Name: nucleoporin 37kDa
  Uniprot ID: Q8NFH4
  ENST ID: ENST00000552283
  CDS Start-End: 141-1121
aagcagagccacagcgcgtcgcggcagcccccaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaattatttttctactctgttctctgtgtgtgtatatatatatatttttaatcttacaaaatcatattgactcagcagctcacctccagagaagagatgactaaggaaaaataatgcttttgagtttatcaaaaaaggagtatttgaagtgtatcctgttttctatactttgagtatatgctgtttttctaattctcagggacacatttatcaaaagagaaaaaaaggccaggtacaatggctcacacttgtaatcccaacactttgggaggctgaagggagtggatcacttgaggtgaggagttcaagaccaacctggccaacatggtgaaaccctatctctactaaaaaaataaaaataaaaaaaattagccaagcatggtttggaagactgaggcaggagaatcacttgaacctggaaggcagaggttacagtgagccaagatcgtgccacttcactgcagcctgggcgacagagcgagactatctcaaaagaaaaaaaatccaaggagaaaaaaatatcttagggtattctggaagtggttgttgagtatatatatgtgtatgtgtactcaatttaatgtaaaaaattgttttcagtttcttaaatatgtgattgattatattgctcaaccctgtttattatacgcagattcctttggacgaggtgttctaacagtcttagaacatctgatatatgggatcaaaagttaccttgaaaaatgacttctagtgtatacctttaacagcctcctttttgtgaattttcactgttcttaccaagaaacttaagtgtttttgagatgggacctgttggcaatggaactgtgttcaccctctcaaagatcattaaaatcaacgttatctaagacagctgtatcacatttttgggatacatcatggtacagtcagaagcatataaaattatggttctgcttgtcagtcacatacagaatccaatacattttgacaaactgcccattcctgcaagttaatgccctttttgaagcttcatttcctcttgtaaagtacagataggaatcattattttgtggagttgctgtaaagattaaataaaggtgaatgaaaata

SEQ ID NO: 161290 - DNA, 762 bp, Homo sapiens
  Payload ID: 11500
  Gene Symbol: NUP37
  Gene Name: nucleoporin 37kDa
  ENST ID: ENST00000551744
  CDS Start-End: 137-762
agagccacagcgcgtcgcggcagcccccaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatc

SEQ ID NO: 161291 - DNA, 645 bp, Homo sapiens
  Payload ID: 11500
  Gene Symbol: NUP37
  Gene Name: nucleoporin 37kDa
  ENST ID: ENST00000550459
  CDS Start-End: 492-645
tattttaatttttaagttccgggatacgtgtgcgggacgtgcaggtttattacaaaggtaaaacgtgtgctatggtggtttgcacacccatcacctaggtattaagctccacatgcattagctatttatcctgatgctctccctccgcccaaccccctgaacattatttttatatcacacattttggtactccttaacaacagatcctgtattttctatctgtttatattatagcccttttcacgttgagtcataactatccctaaactgtggtctccttcaagccaggaggctgtttttttcttcattagcgctggttctccacacacaatgaagtcttccaaatcctggccctgcttatgagcttggcaagttagttaacctactgaagcctcagtttctccatctacaaaatggagaccagagtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttc

SEQ ID NO: 161292 - DNA, 3874 bp, Homo sapiens
  Payload ID: 11501
  Gene Symbol: NUP43
  Gene Name: nucleoporin 43kDa
  Uniprot ID: Q8NFH3
  ENST ID: ENST00000340413
  CDS Start-End: 78-1220
gttccgcgggaagaggcggtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaatttttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatatatattttttgagatggagttttgctcttgttgctgaggctggagtgaaatggcatgatctcagctcactgcaacctccgtctcttaggttcaagcaattctcctgcctcagcctcccgagtagctgggattacaggtgctcaccaccacacccagctaatttttgtatttttagtagagatggggtttcactgtgttggccaggctggtcttgaactgacctcatgatccacctgcctcagcctcccaaaatgctgggattacaggcttgagccactgctcccggctgatttttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctataatcccagctacttgggaggctgaggcaggagaattgctcaaacccgggaggcagaggttgcagtgacccaagatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaactgaaa

SEQ ID NO: 161293 - DNA, 882 bp, Homo sapiens
  Payload ID: 11501
  Gene Symbol: NUP43
  Gene Name: nucleoporin 43kDa
  ENST ID: ENST00000367402
  CDS Start-End: 58-621
gctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccataggactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggtaaaactttttaatgaatactgttatgtgtacttttttttttttttt

SEQ ID NO: 161294 - DNA, 1089 bp, Homo sapiens
  Payload ID: 11501
  Gene Symbol: NUP43
  Gene Name: nucleoporin 43kDa
  Uniprot ID: Q8NFH3
  ENST ID: ENST00000367404
  CDS Start-End: 34-888
ctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagtgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggc

SEQ ID NO: 161295 - DNA, 1012 bp, Homo sapiens
  Payload ID: 11501
  Gene Symbol: NUP43
  Gene Name: nucleoporin 43kDa
  ENST ID: ENST00000403890
  CDS Start-End: 66-419
gaggcggtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggtaaaactttttaatgaatactgttatgtgtactttttttttttttttttaagacagagtctcactctatcacccaggctggaatgcagtggcacgatctcagctcactgcaacctccgcctcctgggttcaagcgattctcgtgcctcagcctcccgagtagccaggactactagtcatgcaccaccgtgcccggctaatttttttgtattttt

SEQ ID NO: 161296 - DNA, 576 bp, Homo sapiens
  Payload ID: 11501
  Gene Symbol: NUP43
  Gene Name: nucleoporin 43kDa
  ENST ID: ENST00000543637
  CDS Start-End: 41-576
gtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgagacaaaactttctgttttacaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatag

SEQ ID NO: 161297 - DNA, 5233 bp, Homo sapiens
  Payload ID: 11502
  Gene Symbol: NUP50
  Gene Name: nucleoporin 50kDa
  Uniprot ID: Q9UKX7
  ENST ID: ENST00000347635
  CDS Start-End: 467-1873
agccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaactttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcgtttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggcctttttttttttttttttaaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaagcaggcactcagaacacaggtcaccgtatgttctcagccagtaacaatcatactgaggacgaaggactctccgtttgatgcagacacaattgtaatggagatgtaaaacttcttagcaatcagatggataaattgtttgctttttactttaaataggaaattgttttctaaaactaaaatacttgaattgtcagacaatataatctcagcttgtattagtttttgaatgctcccatcgaggaagtgtaacaatccatgaaatgtgaataaatgaaaagtaaacaaaatccc

SEQ ID NO: 161298 - DNA, 1895 bp, Homo sapiens
  Payload ID: 11502
  Gene Symbol: NUP50
  Gene Name: nucleoporin 50kDa
  Uniprot ID: Q9UKX7
  ENST ID: ENST00000396096
  CDS Start-End: 398-1720
ggggtgggatgacagcggcgacgcagccccggctgtttttgaagcggggcccgggccccaccgggctgcggcgtccgactcgagtgagactctcccctgcggccccgccggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaa

SEQ ID NO: 161299 - DNA, 2059 bp, Homo sapiens
  Payload ID: 11502
  Gene Symbol: NUP50
  Gene Name: nucleoporin 50kDa
  Uniprot ID: Q9UKX7
  ENST ID: ENST00000407019
  CDS Start-End: 562-1884
gttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaa

SEQ ID NO: 161300 - DNA, 763 bp, Homo sapiens
  Payload ID: 11502
  Gene Symbol: NUP50
  Gene Name: nucleoporin 50kDa
  ENST ID: ENST00000434760
  CDS Start-End: 308-400
ttcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtc

SEQ ID NO: 161301 - DNA, 1018 bp, Homo sapiens
  Payload ID: 11502
  Gene Symbol: NUP50
  Gene Name: nucleoporin 50kDa
  ENST ID: ENST00000419387
  CDS Start-End: 13-105
aggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtgggaacattctccatggccagtgaggaagtcttgaagaatagagccataaagaaagcaaagcgcagaaatgttggatttgaagttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaag

SEQ ID NO: 161302 - DNA, 584 bp, Homo sapiens
  Payload ID: 11502
  Gene Symbol: NUP50
  Gene Name: nucleoporin 50kDa
  ENST ID: ENST00000417702
  CDS Start-End: 560-584
agattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggtgggaacattctccatggccagtgaggaagtcttgaaga

SEQ ID NO: 161303 - DNA, 537 bp, Homo sapiens
  Payload ID: 11502
  Gene Symbol: NUP50
  Gene Name: nucleoporin 50kDa
  ENST ID: ENST00000430547
  CDS Start-End: 308-537
ttcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaagttctcttgctgcaaatggccctaccaccttggttgataaagtttcaaatcccaaaactaatggggacagtcagcag

SEQ ID NO: 161304 - DNA, 443 bp, Homo sapiens
  Payload ID: 11502
  Gene Symbol: NUP50
  Gene Name: nucleoporin 50kDa
  ENST ID: ENST00000445721
  CDS Start-End: 414-443
gggcggggcgcgcggtgggggagcgacgggtggagggtggggtgggatgacagcggcgacgcagccccggctgtttttgaagcggggcccgggccccaccgggctgcggcgtccgactcgagtgagactctcccctgcggccccgccggagatgaagaaactgaggcacaaaaattaaatataacttgcccaagttctcacagctagaaaatggcaaaactgggatgccagcatcttttagtattttttgaaatactttatgctcactggggaaatacttccccagctcactgatctaatgacagacaggacacctgctgtttgagctgggcactgttggggcatttggagtatatctgtaaacaaaacaaagatccctgcgttttggttatatactgatttggttcgaaaacatggccaaaagaaatgccgagaaggaactg

SEQ ID NO: 161305 - DNA, 551 bp, Homo sapiens
  Payload ID: 11502
  Gene Symbol: NUP50
  Gene Name: nucleoporin 50kDa
  ENST ID: ENST00000432340
  CDS Start-End: 539-551
gtttttgaagcggggcccgggccccaccgggctgcggcgtccgactcgagtgagactctcccctgcggccccgccggaggtagggggctggcagggctgtcctggcgtggtcttctccgtttccttcctagcgattcctctcgagcttcctctccccctggccgcccctcgtctctcttctcttgggcgcattacctctctggcctgtcttactgcgttcccgggttattcatcacccatttgctcggttccattaagaaccagcttggagattagatgaagaaactgaggcacaaaaattaaatataacttgcccaagttctcacagctagaaaatggcaaaactgggatgccagcatcttttagtattttttgaaatactttatgctcactggggaaatacttccccagctcactgatctaatgacagacaggacacctgctgtttgagctgggcactgttggggcatttggagtatatctgtaaacaaaacaaagatccctgcgttttggttatatactgatttggttcgaaaacatggccaaaagaa

SEQ ID NO: 161306 - DNA, 579 bp, Homo sapiens
  Payload ID: 11502
  Gene Symbol: NUP50
  Gene Name: nucleoporin 50kDa
  ENST ID: ENST00000424634
  CDS Start-End: 443-579
ttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggagatggagtcttgctctgtcacataggctggagtgcattggcgcgatctcagctcactgcaacctccacctcctgggttcaagagattctcctgcctcagcctccggagtagctgggattacaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcag

SEQ ID NO: 161307 - DNA, 543 bp, Homo sapiens
  Payload ID: 11502
  Gene Symbol: NUP50
  Gene Name: nucleoporin 50kDa
  ENST ID: ENST00000422489
  CDS Start-End: 8-543
cgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaa

SEQ ID NO: 161308 - DNA, 2367 bp, Homo sapiens
  Payload ID: 11503
  Gene Symbol: NUP54
  Gene Name: nucleoporin 54kDa
  Uniprot ID: Q7Z3B4
  ENST ID: ENST00000264883
  CDS Start-End: 142-1665
cttggcgccttccggcctcttaggctaggtcagaaaggaggcggaactcggtgatctgactggcggtttcccggccggactgagaaggggagcgcgctgcgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactacattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaacaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattactttta

SEQ ID NO: 161309 - DNA, 1563 bp, Homo sapiens
  Payload ID: 11503
  Gene Symbol: NUP54
  Gene Name: nucleoporin 54kDa
  Uniprot ID: Q7Z3B4
  ENST ID: ENST00000514987
  CDS Start-End: 24-1403
acttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactgcattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctg

SEQ ID NO: 161310 - DNA, 500 bp, Homo sapiens
  Payload ID: 11503
  Gene Symbol: NUP54
  Gene Name: nucleoporin 54kDa
  ENST ID: ENST00000514901
  CDS Start-End: 25-500
tacttggtctcctgctttcgcgacatggccttcaattttggggctccctcgggcacctccggtaccgctgcagccaccgcggcccccgcgggatttggtgggcttgagactgccaactccaccgccagtgggtttaattttgggggtttcggattaactgctaatcctgcagtgaactttaatattgggaatttcggtgtttctactacctcggcgactccgttcaattttggtaacagtctggcaagtgcaggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactagtaagtatgaggttttcag

SEQ ID NO: 161311 - DNA, 1385 bp, Homo sapiens
  Payload ID: 11503
  Gene Symbol: NUP54
  Gene Name: nucleoporin 54kDa
  ENST ID: ENST00000512151
  CDS Start-End: 24-332
acttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactagcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaag

SEQ ID NO: 161312 - DNA, 579 bp, Homo sapiens
  Payload ID: 11503
  Gene Symbol: NUP54
  Gene Name: nucleoporin 54kDa
  ENST ID: ENST00000513352
  CDS Start-End: 24-278
acttggtctcctgctttcgcgacatggccttcaattttggggctccctcgggcacctccggtaccgctgcagccaccgcggcccccgcgggatttggtgggcttgagactgccaactccaccgccagtgggtttaattttgggggtttcggattaactgctaatcctgcagtgaactttaatattgggaatttcggtgtttctactacctcggcgactccgttcaattttggtaacagtctggcaagtgcagatctgctattactaaaacatttttgatgttgtggagcatgatgagaaactgactagtgtttctattgcgtagccaattcagattatatcatagttattctatggaagtgaagaataatgaaaagaaattacaacagtgcttagtactgtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaa

SEQ ID NO: 161313 - DNA, 1938 bp, Homo sapiens
  Payload ID: 11503
  Gene Symbol: NUP54
  Gene Name: nucleoporin 54kDa
  ENST ID: ENST00000507257
  CDS Start-End: 43-351
cgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactagcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatgtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaacaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttatataa

SEQ ID NO: 161314 - DNA, 1604 bp, Homo sapiens
  Payload ID: 11503
  Gene Symbol: NUP54
  Gene Name: nucleoporin 54kDa
  ENST ID: ENST00000502850
  CDS Start-End: 32-448
agtaacctacttggtctcctgctttcgcgacatggccttcaattttggggctccctcgggcacctccggtaccgctgcagccaccgcggcccccgcgggatttggtgggcttgagactgccaactccaccgccagtgggtttaattttgggggtttcggattaactgctaatcctgcagtgaactttaatattgggaatttcggtgtttctactacctcggcgactccgttcaattttggtaacagtctggcaagtgcagaaacacattcttgttgtttggaggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttac

SEQ ID NO: 161315 - DNA, 2489 bp, Homo sapiens
  Payload ID: 11504
  Gene Symbol: NUP58
  Gene Name: nucleoporin 58kDa
  Uniprot ID: Q9BVL2
  ENST ID: ENST00000381718
  CDS Start-End: 142-1905
cttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtt

SEQ ID NO: 161316 - DNA, 4332 bp, Homo sapiens
  Payload ID: 11504
  Gene Symbol: NUP58
  Gene Name: nucleoporin 58kDa
  Uniprot ID: Q9BVL2
  ENST ID: ENST00000381736
  CDS Start-End: 251-2050
actcacgtaccagggctcattgcgtgacggttacacttccggcgggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcatgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtcagttgctttga

SEQ ID NO: 161317 - DNA, 1659 bp, Homo sapiens
  Payload ID: 11504
  Gene Symbol: NUP58
  Gene Name: nucleoporin 58kDa
  ENST ID: ENST00000381747
  CDS Start-End: 128-1659
gggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtgataagtggtgtaatgtagcagagcttaagaatagaactcaattatcactttttgtgaacaagttggaattgtcatgttactgtgtaattgattt

SEQ ID NO: 161318 - DNA, 1408 bp, Homo sapiens
  Payload ID: 11504
  Gene Symbol: NUP58
  Gene Name: nucleoporin 58kDa
  ENST ID: ENST00000394327
  CDS Start-End: 1-1392
ctcaattttggaaatcttggaagtacttcaactccagcaactacatctgctccttcaagtggttttggaaccgggctctttggatctaaacctgccactgggttcactctaggaggaacaaatacaggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtgataagtggtgtaatgtagcagagcttaagaatagaactcaattatcactttttgtgaacaagttggaattgtcatgttactgtgtaattgatttgctttacaatgaacaataaatttaataaaataaaa

SEQ ID NO: 161319 - DNA, 563 bp, Homo sapiens
  Payload ID: 11504
  Gene Symbol: NUP58
  Gene Name: nucleoporin 58kDa
  ENST ID: ENST00000490231
  CDS Start-End: 150-260
agccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagatgaaaactactccaatcaacttcttcaatctgttctgccacattttagccagacaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccaca

SEQ ID NO: 161320 - DNA, 605 bp, Homo sapiens
  Payload ID: 11504
  Gene Symbol: NUP58
  Gene Name: nucleoporin 58kDa
  ENST ID: ENST00000481980
  CDS Start-End: 219-407
acacttccggcgggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagttccacaaccctgcttaggctattgtcattcgtggaacaaatatttattggacagattcccatgtgcaaggctctgttttagatgaaaactactccaatcaacttcttcaatctgttctgccacattttagccagacaacccttctgtggggctcaattttggaaatcttggaagtacttcaactccagcaactacatctgctccttcaagtggttttggaaccgggctctttggatctaaacctgccactgggttcactctaggaggaacaaatacagg

SEQ ID NO: 161321 - DNA, 6360 bp, Homo sapiens
  Payload ID: 11504
  Gene Symbol: NUP58
  Gene Name: nucleoporin 58kDa
  Uniprot ID: Q9BVL2
  ENST ID: ENST00000463407
  CDS Start-End: 144-1601
gccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtctgaacgcattcaagttatagcttcttactgttccaatgcagaacatttatgtgcgtttttataagtcttccatttgtgtgagcactgaagaaatttctatgagtagctgttccaatacaatctaaaattgtgatggacacgattataaacatacctgataaaaaaggcagggtagtcttagcaataattatacatcaattagatattgaatattgtgaatctacttaatgttatttgctgtaatgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaaaaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcattgttaagttatggagggaaaaagtcattatgggattgattcctttgaggattgatatttcttcttaaaaggattcaatcccataattatgaccatcagctctcatgattacctaaccagttaatcaaaccaaccatagtactagtttactttttagagccagtattaatcctaaagtagataagtgtagatttggttaagtgttctttaaacatagtgaatttccattctattaaatagaacttgagaaatgtcagttatataaaaagttatgttgtaagtgaatatattctatgataaatacctaaacttgaagcaaaatctcctgtcaagggtttgtgtgtgtgtgtgtgtttaactttcttatctatagattattattttgagaaattcataggttttcacttatacattttgagcttgtggacatatggagatgtgtgttcattctctaaatgagtgcctactatgtgctgggctcgaggaatacaaaggtagacaatatagattttgtctttgccctctgtggtggttgacaatgttagcttaatctggagtattcttgaggagccttttgctcataggctttaattttgtctgtgacttttgccaggctttggggaaattgactgccttcactcttccctgaaactttgaagtccacataagggctttctcatcagatggcagaaattataatttattaacctaaacaaccttacagtgttttcgctttgaattgtatgaattcttagaactgagaagctaaacaacagtgataacaattttacattatcttttctttctccttttgtttctctaaaggtctcccaggccttcccagtcaaaattttcgttatttttagtcatgtcaccatgatgtgagatttctgagctctgttagatacatttagaaatgtccctatttatcaaatggtgttttgtaccccataagttatcccttatgccctgtgacttctgtgaaatctttgtttttaagtgccagtaacaaattttagaccatctagatgagggtagagagagcttatgcattgtttttatacatcactgttgatctatacaagatttgagttatcagaagggttttgcttttatttgcatatgaaatttttattaacatgaatatgggcacagagcaaatagcttcttagactgctgccttctgaaggtggcttctgtatctttctcagaggaggaggaatagacttaaacgacttctttgtcctccttcaattttttttttaatgaaaaagtatactagggcttaggcatgtgtgatttacagttatttgttctgaaggctgcagagaattgaaaatccagcaggctatttgtgtatgaaatcatgagcatcgataacgtggataacgtagttccatgttggcagaacttgacacttgtctataagtgcttcccaagcctcctgaaaaactgaagacatttacattaggcttttcagtataattttaatttaggataggttttttagcaatgtatctgggattgagttttgctattgtgttttgacactttaagagttcttgatgtttacataataagactttcttatgtgacttagctgctgttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatactaattacattaggcatttggggtgatcatggaaaattataaaatatttttagcactttagtcctttttctgttaatgcagttttacttttaagaaagtaaaatttattctggaaaatatgaattacagcgctaaacctggttttgttgtgtgtgaatatattatatggtaacttttgtaaaatgttactctacatgaagatttcactttggccagtcattggtatatatcactacaaacttaattttatttatggaaataagaacctctcattggatgactattcaaatttcaaagcagacttcttgaattgtttacgtaacttttgcctgaaggatttagactgctttctaatagtgaaactaatatatatggtggccagagtgtaatatatgctaatactttggcatgggagatatttatcatgagtttttactattaaaaaatgttatacatttgcctacgagttttataaatgatgttgccttcagaatttgtgtgaaggtacaaaactaaaaatatcatgtatctgatgtgcaatggaaagtcttgtcatcattagatatgagttcttgattatattctgaatattgatgattagaaaaatcttatgttctgttgctcttaacaacagacccacacacaacaaaaagcatgctatttgagtaactcttacgacttacaaggctgagggctgtggtgtgcattattctttagggtcttccaccagcagtgcctcctattaacctgtgacaaacaagtctctcaatgttaaagaactggacatgtgttttttatgttttttgttaggaatcagaaagtataataatatgcttggtttctttttcctatagtaacattttacaaaagagctgctaggcaggtattttattctcaaagtgatctcaaactggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaat

SEQ ID NO: 161322 - DNA, 551 bp, Homo sapiens
  Payload ID: 11504
  Gene Symbol: NUP58
  Gene Name: nucleoporin 58kDa
  ENST ID: ENST00000465068
  CDS Start-End: 150-536
agccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctggaaaacaacacatctgtttatcagcaaagttttggactggatcagctgcaaacacaagaacgccagccactacatctgcagctacaacaggcttcagtttaggattcaataaacctg

SEQ ID NO: 161323 - DNA, 2870 bp, Homo sapiens
  Payload ID: 11505
  Gene Symbol: NUP62
  Gene Name: nucleoporin 62kDa
  Uniprot ID: P37198
  ENST ID: ENST00000352066
  CDS Start-End: 606-2174
agctctttcactacggggcactggtgggctactgcgcaggaacaaccaagcacgaagaatcgtttagaaaaaaaaaaaacacaccctcccctggagtgctcaggcccagctgcacgcgggctgacaaacatcgagtctagaactctcccacccggccccgggcccagtgcgcatgcgcagccgcgcgccttcggcccaccgtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaa

SEQ ID NO: 161324 - DNA, 3479 bp, Homo sapiens
  Payload ID: 11505
  Gene Symbol: NUP62
  Gene Name: nucleoporin 62kDa
  Uniprot ID: P37198
  ENST ID: ENST00000422090
  CDS Start-End: 497-2065
attcagggtccgcagctctttcactacggggcactggtgggctactgcgcaggaacaaccaagcacgaagaatcgtttagaaaaaaaaaaaacacaccctcccctggagtgctcaggcccagctgcacgcgggctgacaaacatcgagtctagaactctcccacccggccccgggcccagtgcgcatgcgcagccgcgcgccttcggcccaccgtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 161325 - DNA, 587 bp, Homo sapiens
  Payload ID: 11505
  Gene Symbol: NUP62
  Gene Name: nucleoporin 62kDa
  ENST ID: ENST00000600935
  CDS Start-End: 519-587
gattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgggcctccctctttccatttccagcttttagagctgcttctgccttccttggctcctggctttctcacatcttcagattccaaagcgcatcactccagtctgctcgtgtcaccacaagctttcttcccttctccagtcagtcaaatccgtcttctaaggatactgctgatcatctttagggctcacgcctgtagtcctggcactttgagaggacaaagagggaggatcgcttgagcccaggagttgaagaccagggcaacagaaaatcttcccaaggctgcagacaccgacggatttgctttgggagccagagtagctgccgccaccagagtccggagccatgagcgggtttaattttggaggcactggggcccctacaggcgggttcacgtttggcactgcaaagacg

SEQ ID NO: 161326 - DNA, 894 bp, Homo sapiens
  Payload ID: 11505
  Gene Symbol: NUP62
  Gene Name: nucleoporin 62kDa
  ENST ID: ENST00000596437
  CDS Start-End: 668-894
gtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcgggcctccctctttccatttccagcttttagagctgcttctgccttccttggctcctggctttctcacatcttcagattccaaagcgcatcactccagtctgctcgtgtcaccacaagctttcttcccttctccagtcagtcaaatccgtcttctaaggatactgctgatcatctttagggctcacgcctgtagtcctggcactttgagaggacaaagagggaggatcgcttgagcccaggagttgaagaccagggcaacagaaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttt

SEQ ID NO: 161327 - DNA, 564 bp, Homo sapiens
  Payload ID: 11505
  Gene Symbol: NUP62
  Gene Name: nucleoporin 62kDa
  ENST ID: ENST00000599788
  CDS Start-End: 494-564
agggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgacagggcctccctctttccatttccagcttttagagctgcttctgccttccttggctcctggctttctcacatcttcagattccaaagcgcatcactccagtctgctcgtgtcaccacaagctttcttcccttctccagtcagtcaaatccgtcttctaaggatactgctgatcatctttagggctcacgcctgtagtcctggcactttgagaggacaaagagggaggatcgcttgagcccaggagttgaagaccagggcaacagaaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggc

SEQ ID NO: 161328 - DNA, 533 bp, Homo sapiens
  Payload ID: 11505
  Gene Symbol: NUP62
  Gene Name: nucleoporin 62kDa
  ENST ID: ENST00000595761
  CDS Start-End: 132-533
agctcccgccaggcgactgcaacagtctcctcactcctcccacacagagtctcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggc

SEQ ID NO: 161329 - DNA, 1824 bp, Homo sapiens
  Payload ID: 11505
  Gene Symbol: NUP62
  Gene Name: nucleoporin 62kDa
  ENST ID: ENST00000597723
  CDS Start-End: 350-1690
agggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatga

SEQ ID NO: 161330 - DNA, 564 bp, Homo sapiens
  Payload ID: 11505
  Gene Symbol: NUP62
  Gene Name: nucleoporin 62kDa
  ENST ID: ENST00000594673
  CDS Start-End: 457-564
aaaggcagttggagaagaggtaagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcggtccttaatgcaagtcggttatgcctgtaggttgaaaggcatcagggaggaaaatgggaccagaatgccaggtgacctaaggaggagagagagaggacagttgaaaacccacagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacc

SEQ ID NO: 161331 - DNA, 567 bp, Homo sapiens
  Payload ID: 11505
  Gene Symbol: NUP62
  Gene Name: nucleoporin 62kDa
  ENST ID: ENST00000600645
  CDS Start-End: 270-567
gctcagcttctccctggaacctgctcccacagcatgtggcccggccctgtgcctgccctgagccctggttgtagagctgacatttgactctggctgccttgagggcagggaccgtggcttaaccagccactctgggcttcactttcctcatttgtcaagtggatctgccccaaagtttgctttgaggaaacgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttga

SEQ ID NO: 161332 - DNA, 473 bp, Homo sapiens
  Payload ID: 11505
  Gene Symbol: NUP62
  Gene Name: nucleoporin 62kDa
  ENST ID: ENST00000596680
  CDS Start-End: 418-473
agttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggtccttaatgcaagtcggttatgcctgtaggttgaaaggcatcagggaggaaaatgggaccagaatgccaggtgacctaaggaggagagagagaggacagttgaaaacccacagaaatcttcccaaggctgcagacaccgacggatttgctttgggagccagagtagctgccgccaccagagtccggagccatgagcgggtttaattttggaggcactggggcccctacaggcgggttcacgtttgg

SEQ ID NO: 161333 - DNA, 3590 bp, Homo sapiens
  Payload ID: 11505
  Gene Symbol: NUP62
  Gene Name: nucleoporin 62kDa
  Uniprot ID: P37198
  ENST ID: ENST00000596217
  CDS Start-End: 1889-3457
gattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtggtgagcgcggagacgggccgggggcacaaaggggtcgaggctacagagccatggccggggctacgcaggcagaggcggcgacactgtagtgagaagagactgtgatccgaggacagggaatgaggcggccccggggactggggacagatatatactgggtggcggagcacggccctcccggatccttccgcgccccgccctcgcgcggccccaaccgggaggcagccgggtcccctcctcctggggatcaggggatccgagcctttccttcccactcctagggtccgggaccctcctccctctcagctggggatccgacctcttccctctgagccggggatccagccctctccttgtggctccggggtctggtttcctcctcctgactctaagctctggtttctttctctttctgcctctgaggtctgggcctgcttcctcctgtgattttgaggatccagcctcattctcttcccgcagacctgcaccagttcatttctctttccctttccttgcttgcagaatttcctgccagtcacttttcacttcttcatcccccagctgctgactctgagaaaccctcgtgggttagagtccagcatgagtcacagcactctcccaaatacagacctgccaggatggcctcgggcaaataacttaagttctcttacttcatttccctatctgtaaaataagaaaaatcaactcgcctggtgggtttatgagactcaaataagacgatgtctggcaagccttatgcacagagctcaactcatacattcctgttcaactgttttttttttttgagacggagtctctccgtctctgtcgcccaggctggagtgcagtggcgcgatctcggctcactgcaaactccgcctcccaggttcacgccattctcctgcctcagcctcccgagtagctgggactacaggcgcccgccaccacgcccggctaattttttgtatttttagtagagacggggtttcactgtgttagccaggatggtctcaatttcctggcctcgtgatccgcccgcctcggcctcccaaagtgctgggattacaggcgtgagccatcgctcccggcctcagcatattttattaataggaactctggggcccagtctcatttcttccttaccacttgtaagagccgcagacgttggactgtccaacacctgctgtcattcttctgtctccctcatccctctaaagtgtctgtttccagctatcctcatcttccattccaaatgatgggtgcccaggccccatcccctggcagggattcagacatcgaggccccagctgcgtccttttctccatcccttgcccttggcttcctttcaaaccgtccttcagcttccactggataggaactatctcccaaccctgccaaaaatggaagatctccgttttcgtttagtcacagggtagccatcttgccccttctcatgcactgggccctcctccaccagccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatg

SEQ ID NO: 161334 - DNA, 579 bp, Homo sapiens
  Payload ID: 11505
  Gene Symbol: NUP62
  Gene Name: nucleoporin 62kDa
  ENST ID: ENST00000599567
  CDS Start-End: 280-579
gattccccgctcgcgactccccaccccccagggctccctaaagagggccacgagctgcgaaagggcgggaaaggcagttggagaagaggtccttaatgcaagtcggttatgcctgtaggttgaaaggcatcagggaggaaaatgggaccagaatgccaggtgacctaaggaggagagagagaggacagttgaaaacccacagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagc

SEQ ID NO: 161335 - DNA, 905 bp, Homo sapiens
  Payload ID: 11505
  Gene Symbol: NUP62
  Gene Name: nucleoporin 62kDa
  ENST ID: ENST00000593652
  CDS Start-End: 493-905
gattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggtccttaatgcaagtcggttatgcctgtaggttgaaaggcatcagggaggaaaatgggaccagaatgccaggtgacctaaggaggagagagagaggacagttgaaaacccacagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccac

SEQ ID NO: 161336 - DNA, 2053 bp, Homo sapiens
  Payload ID: 11505
  Gene Symbol: NUP62
  Gene Name: nucleoporin 62kDa
  Uniprot ID: P37198
  ENST ID: ENST00000597029
  CDS Start-End: 351-1919
agggcgggaaaggcagttggagaagaggtaagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatga

SEQ ID NO: 161337 - DNA, 1755 bp, Homo sapiens
  Payload ID: 11506
  Gene Symbol: NUP62CL
  Gene Name: nucleoporin 62kDa C-terminal like
  Uniprot ID: Q9H1M0
  ENST ID: ENST00000372466
  CDS Start-End: 253-807
agtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaagggtttggagtcatcagcaggtttaattttggaggaactttacaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagtgtagtagcaactcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaattggattttatcctgtcacagcagcaggaactagaatttctgttgacttatttagaggagtctacgcgtgaccagagtggacttcattatctgcaggatgcagatgaggagcatgtggagatctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatccttctcactccagttgaatcatagggtgatgtctgccaaaagtacatgccaacctatatagtgctagatactgtaaagtctcttctcctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtcctaaaaaaaaacatgtaatactgaaattaactattaaaagtttttaagtgactaga

SEQ ID NO: 161338 - DNA, 618 bp, Homo sapiens
  Payload ID: 11506
  Gene Symbol: NUP62CL
  Gene Name: nucleoporin 62kDa C-terminal like
  ENST ID: ENST00000421752
  CDS Start-End: 209-618
agtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagtgtagtagcaactcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaatt

SEQ ID NO: 161339 - DNA, 688 bp, Homo sapiens
  Payload ID: 11506
  Gene Symbol: NUP62CL
  Gene Name: nucleoporin 62kDa C-terminal like
  ENST ID: ENST00000432145
  CDS Start-End: 1-595
tcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaattggattttatcctgtcacagcagcaggaactagaatttctgttgacttatttagaggagtctacgcgtgaccagagtggacttcattatctgcaggatgcagatgaggagcatgtggagatttacagattagcagaaagtatagatgctcagctgaaacaaatggcccaagatctcaaggacgttgttaatcacctgaatacatttgaaagttcttctgacactactgatccgctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatctt

SEQ ID NO: 161340 - DNA, 1515 bp, Homo sapiens
  Payload ID: 11506
  Gene Symbol: NUP62CL
  Gene Name: nucleoporin 62kDa C-terminal like
  Uniprot ID: Q9H1M0
  ENST ID: ENST00000484614
  CDS Start-End: 209-427
agtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagattcgtattttacatggagaagtgaacaaagtgaaactggatcagaaaagattggaacaagaattggattttatcctgtcacagcagcaggaactagaatttctgttgacttatttagaggagtctacgcgtgaccagagtggacttcattatctgcaggatgcagatgaggagcatgtggagatctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatccttctcactccagttgaatcatagggtgatgtctgccaaaagtacatgccaacctatatagtgctagatactgtaaagtctcttctcctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtcctaaaaaaaaa

SEQ ID NO: 161341 - DNA, 2121 bp, Homo sapiens
  Payload ID: 11507
  Gene Symbol: NUP85
  Gene Name: nucleoporin 85kDa
  Uniprot ID: Q9BW27
  ENST ID: ENST00000245544
  CDS Start-End: 72-2042
gctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgta

SEQ ID NO: 161342 - DNA, 1926 bp, Homo sapiens
  Payload ID: 11507
  Gene Symbol: NUP85
  Gene Name: nucleoporin 85kDa
  ENST ID: ENST00000540768
  CDS Start-End: 1069-1848
tttaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctggctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaaaagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgt

SEQ ID NO: 161343 - DNA, 2233 bp, Homo sapiens
  Payload ID: 11507
  Gene Symbol: NUP85
  Gene Name: nucleoporin 85kDa
  ENST ID: ENST00000581104
  CDS Start-End: 43-552
attggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccaggtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgaaggttgcagcagcagtggttttctttgcttgtcagtccctgctagagcttagttgtatagctgttgccgatgtgcgtgtttcctcctttgtcgttctgcctgtgcgcgtgtattccccttagcgccctctctgggattccagactcacacaggaaacaaacactgcttgatttgaaatgaggtattcgtatacaaagcacactattgcgaagggtatgaaaggaagaacgtccgaacatgggcccctgccccaaccaatgcaggccagggctgggggcagccaagcaaggcaggctctcttccctaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggc

SEQ ID NO: 161344 - DNA, 373 bp, Homo sapiens
  Payload ID: 11507
  Gene Symbol: NUP85
  Gene Name: nucleoporin 85kDa
  ENST ID: ENST00000579838
  CDS Start-End: 1-295
gtccttgatgacgtctcggattgcccctcggtctttctggatgactctgctgacagacgccttgccccttttggaacagaaacaggtgaaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgt

SEQ ID NO: 161345 - DNA, 553 bp, Homo sapiens
  Payload ID: 11507
  Gene Symbol: NUP85
  Gene Name: nucleoporin 85kDa
  ENST ID: ENST00000583569
  CDS Start-End: 193-553
agacgcccaggcggagtcttgtctcgcagccagctctgagcgggaggcctgagcgggaagcattggcgtccgagcgacttctaggagcctggggttcggcgctatggaggagctcgatggcgagccaacagtcactatttctatgccttattttactagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatgg

SEQ ID NO: 161346 - DNA, 1890 bp, Homo sapiens
  Payload ID: 11507
  Gene Symbol: NUP85
  Gene Name: nucleoporin 85kDa
  ENST ID: ENST00000579298
  CDS Start-End: 43-1878
attggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttgcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaa

SEQ ID NO: 161347 - DNA, 922 bp, Homo sapiens
  Payload ID: 11507
  Gene Symbol: NUP85
  Gene Name: nucleoporin 85kDa
  ENST ID: ENST00000578830
  CDS Start-End: 1-301
tctttttattgaagtggccccagctggccctctcctcctccatctccttgactgggtccggctccatgtgtgcgaggtggacagtttgtcggcagatgttctgggcagtgagaatccaagcaaacatgacagcttctggaacttgattatgctgggagacgaagctgccttgttagagcagaaggaacttctgagtaattggtatcatttcctagtgactcggctcttgtactccaatcccacagtaaaacccattgatctgcactactatgcccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaaggtgagctggccctgctcccagcctactgtctgtgggacgcaggagtcaggggatcctgaggtcacactttatgcctaccccagccatcctcctcctcacgagccacactggagacgtggggctgtggacgccaagagttcgcagcatttgtaagatcttagccatgaaagccgtccgcaacaatcgcctgggttctgccctctcttggagcatccgtgctaaggatgccgcctttgccacg

SEQ ID NO: 161348 - DNA, 583 bp, Homo sapiens
  Payload ID: 11507
  Gene Symbol: NUP85
  Gene Name: nucleoporin 85kDa
  ENST ID: ENST00000580879
  CDS Start-End: 1-60
ttgttggcagcctttgagtttgacatccatcaagtaatcaaagagtgcagcttcctctgaagacgggccagttccttgctgtctggcaagaggaaacagctggggtgcacttcactgggagttgggcaagatgtcggcagtttcctggtgcccttcaagtcctccaaaagtatcgagctaaaagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctt

SEQ ID NO: 161349 - DNA, 2010 bp, Homo sapiens
  Payload ID: 11507
  Gene Symbol: NUP85
  Gene Name: nucleoporin 85kDa
  ENST ID: ENST00000579324
  CDS Start-End: 298-1932
ctgagcgggaagcattggcgtccgagcgacttctaggagcctggggttcggcgctatggaggagctcgatggcgagccaacagtcactaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgt

SEQ ID NO: 161350 - DNA, 528 bp, Homo sapiens
  Payload ID: 11507
  Gene Symbol: NUP85
  Gene Name: nucleoporin 85kDa
  ENST ID: ENST00000579900
  CDS Start-End: 1-345
gccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccagtatggccctttggtattgctttcttttacatcgataatttgctggaagctactatgaatgatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgta

SEQ ID NO: 161351 - DNA, 817 bp, Homo sapiens
  Payload ID: 11507
  Gene Symbol: NUP85
  Gene Name: nucleoporin 85kDa
  ENST ID: ENST00000579557
  CDS Start-End: 1-817
gtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagtttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgcca

SEQ ID NO: 161352 - DNA, 907 bp, Homo sapiens
  Payload ID: 11507
  Gene Symbol: NUP85
  Gene Name: nucleoporin 85kDa
  ENST ID: ENST00000583070
  CDS Start-End: 1-907
ggcacgaggaatgtgagcggtacctccaggacagcacattcgccaccagccctcacctggagtctctcttgaagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggactt

SEQ ID NO: 161353 - DNA, 575 bp, Homo sapiens
  Payload ID: 11507
  Gene Symbol: NUP85
  Gene Name: nucleoporin 85kDa
  ENST ID: ENST00000583877
  CDS Start-End: 1-575
cttgactgggtccggctccatgtgtgcgaggtggacagtttgtcggcagatgttctgggcagtgagaatccaagcaaacatgacagcttctggaacttgggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcag

SEQ ID NO: 161354 - DNA, 300 bp, Homo sapiens
  Payload ID: 11507
  Gene Symbol: NUP85
  Gene Name: nucleoporin 85kDa
  ENST ID: ENST00000584155
  CDS Start-End: 1-57
ctgacagacgccttgccccttttggaacagaaacagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgca

SEQ ID NO: 161355 - DNA, 388 bp, Homo sapiens
  Payload ID: 11507
  Gene Symbol: NUP85
  Gene Name: nucleoporin 85kDa
  ENST ID: ENST00000578987
  CDS Start-End: 1-140
gggagaagcgttttgccgacgcagcttctctccttctgtccttgatgacgtctcggattgcccctcggtctttctggatgactctgctgacagacgccttgccccttttggaacagaaacagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgt

SEQ ID NO: 161356 - DNA, 2194 bp, Homo sapiens
  Payload ID: 11508
  Gene Symbol: NUP88
  Gene Name: nucleoporin 88kDa
  ENST ID: ENST00000225696
  CDS Start-End: 1-2090
ttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaattgttttactcagctaaggaaaataaaggtagaaactttgtttttaagagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatg

SEQ ID NO: 161357 - DNA, 2916 bp, Homo sapiens
  Payload ID: 11508
  Gene Symbol: NUP88
  Gene Name: nucleoporin 88kDa
  Uniprot ID: Q99567
  ENST ID: ENST00000573584
  CDS Start-End: 511-2736
acagacccctgggaggtgtactttccgggtgcagaccgcgaatggatcgcagcgtattctgggaagtgttgttttatcgaccggccccacgtggagacagatttaggcatccaagcgaaatgcgtgaggccagcccgacctgcactgagggaggtaagtcttgagggaaagttctggatgcctgggtttacccagatggaggtgtccaataggcaattagatacacaagtctcaggctctccccaggtgctagatttccagcagcaccaccattatgttgacttctcgtcccgcccccttgggcttcagaaataatggtgattggctttcccttggtgacgcccctgcttggtgggctggcctcgccttcgccccccgacctggcacgagcctctcgagcttccgggccgtctgctcggtgattggccgaaacagtgagtggacggccgcggattggctgtgctcagcggcgggctgagcaactggagtgaggggagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaa

SEQ ID NO: 161358 - DNA, 771 bp, Homo sapiens
  Payload ID: 11508
  Gene Symbol: NUP88
  Gene Name: nucleoporin 88kDa
  ENST ID: ENST00000572809
  CDS Start-End: 312-771
taataacattctatactgctgtgtagcatttgacataatcataacttaattatttataattattttgtgtcttttttttttttttgagatggagtttcgctcttgttgcccaggctggagtgcaatggcgccatctcggctcaccgcaacctccaccttccagtttcaagcgattcttctgcctcagccccccccgcgagtagctgggattacagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttac

SEQ ID NO: 161359 - DNA, 615 bp, Homo sapiens
  Payload ID: 11508
  Gene Symbol: NUP88
  Gene Name: nucleoporin 88kDa
  ENST ID: ENST00000572290
  CDS Start-End: 12-398
gttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccaggctggagtgcaatggcgccatctcggctcaccgcaacctccaccttccagtttcaagcgattcttctgcctcagccccccccgcgagtagctgggattacagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagtt

SEQ ID NO: 161360 - DNA, 800 bp, Homo sapiens
  Payload ID: 11508
  Gene Symbol: NUP88
  Gene Name: nucleoporin 88kDa
  ENST ID: ENST00000576708
  CDS Start-End: 1-332
atattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggacatcaacagcagaccggcaattgcgcttttgatctaaaggaaagatgaaagcctggatcctgcaatacactgagattatagaaaactgcaaagcaaaccaaatccaggttgctctaacttaaattccgcaatgctagtcaggcagattgctccaacctgagagctgtgagttcaggtggggaggttcacattcactgtgattaactagctagctcctttctctgtcacaattacctggaatacccaaggcagactatgacaagggtcaggtga

SEQ ID NO: 161361 - DNA, 2741 bp, Homo sapiens
  Payload ID: 11509
  Gene Symbol: NUP93
  Gene Name: nucleoporin 93kDa
  Uniprot ID: Q8N1F7
  ENST ID: ENST00000308159
  CDS Start-End: 122-2581
gggagcggccagccttggccaatcaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgtatttc

SEQ ID NO: 161362 - DNA, 8257 bp, Homo sapiens
  Payload ID: 11509
  Gene Symbol: NUP93
  Gene Name: nucleoporin 93kDa
  Uniprot ID: Q8N1F7
  ENST ID: ENST00000542526
  CDS Start-End: 490-2580
attgcaaagaatcgatttctgagatgagacaatgagatgtggtttgcattttgtaaagatggaggaaacctctaacactgaccctgtatgggagatgactcaattatccacgccttggtacagttgcaaattatttccctttgtctgaagtgggtggatgccagcgccttcatcagagctccttaatttaatgtatggaaaatgtctcagccaccatttttaacaattagctgtatcatggtcgaggtgagctgtattctgaaggcagctgcaaggccatttcatttacattaggttccatggcacaggagctttgttactgtaaaactaagaaaatgaatttgcacattgtatagaagagttctttaggaaggtggagaatattcccagaaagaaaatggaattcttttgtctacaggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgtatttcttttcaacattcttttattttctttttttttttctttgaaattttgtttacatttttatttgtgtaatgggaaataccgtcactagctcttgggccagggaatgagaggctatgtagatattcattatttggttaaattgaccttaattaattaaaaatctacccaaaatgagccaggaaacaaagcctttgggagttacttttatttagatataatattccatatagcagagtcacgattcattttcacatttttatttgaatgtgaaagtcaacctcagccttagaagatgtaagatttgtgtgtgaaatatcaagcactccatgtcctcctctagagagtgtgacttaagtccagatggtccaagaccatcccccaaatcatcagctctgattgcaggattcatcagtttgccgttctgttgcaatcccagtggagataaaagcatagacctagaaaaagccttaagaaggaaggttgcaagtgcccccagcttgcacttgaggaaggggtaaaccttgccactgcactcctctgtagctgctccactgtgagttgactgctcggccttgtacacacccctcctagaaagacgtttaagcccctatttcccttctctggtggtcagttcctctgctcagacgacccccttccccactcattaaggtaattggccaggcaggctcatgggtcacgtgctgagtctgcaatgtacagaatccagaccaccacatggcatcagcaccatgggtgtttgctccctgagcagtagttgtcacccatcatttgctctgtttcccccaccatcagtcccaaagccctagactaaaccagagagcaaattaggtcgtgtttgttcctgaatgggccaactggagccttgagacagtgggcagtggtctgctctgctggtttgatggacggctccctgaggtagactctttcccagcagaatgttaagatccccaaagggtccccaaaggtgcctttgcttgtagggagaagtttctgtcttgtcacagggtgtggtcatccccactgtctcccagttgttaaaataattgttaccttttcttttgggaagaaataatctgtagataatggaaccaactgctgcttatcggtaggattccatgttccaggaaggatgcggcctgagggtcagtggagctgtgttctgccttcctcctctagtcccatcttgtcaccctggaggactgtcttcaattgagctttactagaaagtcttgaaacatgagccctgcagaggccttgatttagcaagttgtgccctgcttatatgtgctgatttaagctaatcaaatgatttaatagtgctttttaaaaaagagtactcctggccgggtggggtggctcacacctgtaatcctagcactttgggaggccaaggcaggtgatcacctgagatcaggagttcaagaccagcctggccaacattgtgacaccccgtctatactaaaaatacaaaaattagccgggcatggtggcaggcacctgtaatcccagctacacaggaagctgagacagaattgcttgaacccgggaggcgaaggttgcagtgatctgagatcatgccactgcactccagcctgggtgaaagagcgatactccgtctcaaaaaaataaagagtactctggccgagtgcagtggctcacgcctgtaaccccagcactttgggaggccaaggcaggcagttcgcttgaggtaaggggtttgagaccagtctggccaacatggggaaaccccgtttctactaaaaatacaaaaatcagctgggcatggtggcaggcgcctgtaatcccagctactcgggaggctgaggcaggagaatcacttgaacccaagaggcggaggttgcagtgagccgagcttatgccactgcactccagcctaggcgatggagtgaggctctgattcaaaaataaaaataagagtactctgtggacttttcataaagtgcaacttagtgctttgtttttctaatactagattttacttgcagatagaaatataacaatgccacaaatgagaaggctcaagttgtttaaatacatgtttgctcctggcttacctcttcttcactatcccatgagaatcgtggatttgcctttccttgcatcctgcagttctacttgtctcagagagaactgcacaccagccctgcatccaggggatgaggttctttgacctgtagatgggtcctaaaatgagaagggagagaagcagccagaccttgagctgctctgctaggggagctgtgagttgggagaaaagtggtcactggttggcagttaaggacttgctgagagagacatttgtaggagaaagaagataagtaggttcataccagaagggccaggactcggatggagcaaatcccagttcttgtcctacaagctgattgtgcgattgagcacaggcctctggaattgtgcagagatgagaaacaggctgaatttgcaaggccacaacatcaggttgtcatgtacccatcattacagcttatgcccagaagtcctgaccctgtgacaggttattatcttaaaaactcatcttcagcccactttttcagagaactaactctttccttagatgttgggccaggatttcactatttacccagagaaactaagagaaagtggcactaggcgtcttgtcttccagatgtgagatttcgatctttctaatgaaattgggggcactttgagactgtcagggtttgttcctgtctcagaatggctcataataaactcactgaaacactcaaaggaaagtactgacttgatctggatccttttcagaggcctggagatttaatttcacagattctcttcttttggctcaacaacaacagcaacaaaaaactctttgactccccaacttcagagggaaaactgaagcgaaactggtgagctctgccacggcagatgccttcctttttcactcacgagctgggcgggctcatcaaagagcaggaagtgcccattttacactggggccaggatgcagacccagctcctgtcctccgcgaacttacagtctaattagagcctcttaaggacaatttggcagccactgttaactcttgatgcatcatttaaatcctagaacaggcagctttaaagcaaagaactacagacttttccgcagtgtccagcatttgctgaccaaaaaaaacctgagggtgatttttctctctttgaatttttacccttgcctgcacctagccagaacccttaatactaaatttgcagttatatgcagctctgccaacgccttcctgctttagactggatctctactatcctttttctctactaggcaccagaacctttgtctagttcattaggtggttcacatcacttgccaaatttccagcatgccactcaggaagtgacttgagcatgctgaatgctgagtcagaaaatgaacccctgggctggcgggttgacccaggcctgacaaagtcttggcagtccccacactgactgcgaactctcccttagcctcagtcagctgggaaaggaattgagccctgtgtcagcaaattgggagaaagtgttacatataaaattcttgatggaaatgtgtgttttatatcagaattgagcttttgttcctgcatctcagaaataccaggaagaagtcagcatctcattaaacaggagttgtctaaactgtggaagaaaatatcccccattctttatcctacgctgaatccacaagtcttcccatcttccaccatcttctgacagttccataatatattggtatccctcacagggcagggacaggaaggaaataaatctttctgccacttgtttccaaccgaaaaggaaaaaagttaaaaattactaaagtgttctgaaaagagatttcaagtggtctgtgctgcttttttgccttgttacgcacataacttgtgactggctagataggccacgtgtatttatcagccaagattccattgcagcagatgatttcaaaacctctttgtgtgctgggccgtgctaggtagctggaatatctgaggtaaattaagcactgatttgttcccagagttgtgcataattctttaaaagtaggctcgtttttttcgtttttttgtccaggatcacctaagtgaagtactcgtggttctaagttgctaacccagggaaagaggatattttcctgtcctaaccttggtttttgaaatatgcttctcctgtgtgccctctctggggtatctggcccacagtagattgctcagcagatatttgaatgagcagatgctttgctttgtcctcctgtgccaggctcctccccacatcctctggatcagctccacgtgcctagattcagactccgtgattcaccgtgggggcccttaataggcattcagtctgaaagaaggtggaggagaataatgtctcccaggatcaaatgagactcagggctgttccttcaaagacagaaacttgcagagctgcacagcagcagggaaacattgagaagggggtggaaatttgatgtactgtgaataatgaaggccggatctttaaaaagaaaaagggacggggtgctggcagaaacccagctctgcgctagcacaatctgtacacctggctgcctttgcccttgagcttctatttcttggggatggggagggcaaaaaagtttgccccagacactggcttctgtttgaacaggaagtggggagtcagtgatcccagaggggacttcagcatcaggacatatgctttggtggcctcagcagacctggcctaggcaggctttcaggtggcacccaggggctttatggcctgcaggtaaggccccttcatccgggtcagacttagcaaataaaaatataggacactcaattaagtttgcattttggataaacagtgaagaagttcctagtgtaagtatgtcccagttctatgtggctgccctacctgggcttgcctctgctggtactagctgcccagagaccttcaggcctgccacgggctgccgggagctctctagtggaattggattaccctgattttgtgcattgtttgtgcttttgtgggcatcggaaatgactgagatacgcagttttgaagagctaggcaggcagctgagcgggataatgtgggccccagttgacctcagtggctgtcatctactgtgtttttcaaccaggaatttcaaatactgtgtattttagaaagaaaggaaagagccaaagtacagccttttctcacttgatcagtaacttgtgttagaaactcagtgggggagaattctttgcgtttttcagttgactgattattttcctttttttcttttttgcttttctcgagtcactctgtgtggtgcttgtgggagaagggagagggtgggagagcgttggtggatgtgttctgcatgttcctttctgtacagtaacttctgcatttactctgtttaggatggttccttcaccactatccctgtctgtagccagtaaatttctggaatattc

SEQ ID NO: 161363 - DNA, 592 bp, Homo sapiens
  Payload ID: 11509
  Gene Symbol: NUP93
  Gene Name: nucleoporin 93kDa
  ENST ID: ENST00000568656
  CDS Start-End: 58-592
ttccttacctgctttgagtctgtggaaggagacaggaattctggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctgg

SEQ ID NO: 161364 - DNA, 630 bp, Homo sapiens
  Payload ID: 11509
  Gene Symbol: NUP93
  Gene Name: nucleoporin 93kDa
  ENST ID: ENST00000569863
  CDS Start-End: 254-630
gcgagaagcggcggccgcgtcctcaagccggcacctgagcggcggagacggctgtagcacaaggtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtgga

SEQ ID NO: 161365 - DNA, 584 bp, Homo sapiens
  Payload ID: 11509
  Gene Symbol: NUP93
  Gene Name: nucleoporin 93kDa
  ENST ID: ENST00000568283
  CDS Start-End: 465-584
aaatgcaccctggtaaatagagtggcagcatgttgttgcagtgcctctgaaagacaaggtcttggtttgtttgaaaatttgagataaatttggaagcagttaactcatttgatagaagaagtacttgattcttctgagaattgttcagatttgtatcttgccattctaatattttttcttttaaaaatgtattgggtggggcagaatttgcttaaatatttaaatagttggttattgggatttttgtgaacttcttctttaagtagcaagtagtgtggtctttaggatttttaaaggagatacatgtgaagtgcaaaattcttgtatgaggtggaatatgaaaatagaatttattttatttactaaaaccagatccttctttgggattgcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgag

SEQ ID NO: 161366 - DNA, 442 bp, Homo sapiens
  Payload ID: 11509
  Gene Symbol: NUP93
  Gene Name: nucleoporin 93kDa
  ENST ID: ENST00000566678
  CDS Start-End: 1-397
ggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgaggtagcttgaatgcaaaagataaactactgttaataaaaacatgaagtcaaagaa

SEQ ID NO: 161367 - DNA, 315 bp, Homo sapiens
  Payload ID: 11509
  Gene Symbol: NUP93
  Gene Name: nucleoporin 93kDa
  ENST ID: ENST00000567081
  CDS Start-End: 266-315
attcggctcctcttggcattggagttctggatttacccatgactaagattcctttgaaactctgacccagtgcagcattgcaaagaatcgatttctgagatgagacaatgagatgtggtttgcattttgtaaagatggaggaaacctctaacactgaccctgtatgggagatgactcaattatccacgccttgggcttcctgaagaatgagaaggacaatgccctgctgtctgccatcgaagagtcccggaagaggaccttcggcatggctgaggagtaccatcgggagtcaatgttggttgagtgggagcaagt

SEQ ID NO: 161368 - DNA, 604 bp, Homo sapiens
  Payload ID: 11509
  Gene Symbol: NUP93
  Gene Name: nucleoporin 93kDa
  ENST ID: ENST00000567641
  CDS Start-End: 135-604
agacaaatgcaccctggtaaatagagtggcagcatgttgttgcagtgcctctgaaagacaagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatca

SEQ ID NO: 161369 - DNA, 797 bp, Homo sapiens
  Payload ID: 11509
  Gene Symbol: NUP93
  Gene Name: nucleoporin 93kDa
  ENST ID: ENST00000563858
  CDS Start-End: 109-797
cttggccaatcaggaagcgggggagagcggcgcgagaagcggcggccgcgtcctcaagccggcacctgagcggcggagacggctgtagcacaaggatctgcatctccaatggatactgaggggtttgagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactct

SEQ ID NO: 161370 - DNA, 635 bp, Homo sapiens
  Payload ID: 11509
  Gene Symbol: NUP93
  Gene Name: nucleoporin 93kDa
  ENST ID: ENST00000563486
  CDS Start-End: 1-421
ggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaagtaagttccttcttcctgagttgtggaattcctttttccccacttccaccaaaagctttttcttttcctgtacctaacagctttaagaattctagttacagtaactatccagactgagttttccagagtggttccctttcagataccttggcctggcttttctgtgagtgcatacatccccatcagattattgtctgaattcctaattgagaaaatacagtcacttcagtgattgacatgttcttgggagaaacaggtttctggttgatctgtgaagtctggtttaattcttctattatccgcttgtgctagagggtattttagtgcttaa

SEQ ID NO: 161371 - DNA, 589 bp, Homo sapiens
  Payload ID: 11509
  Gene Symbol: NUP93
  Gene Name: nucleoporin 93kDa
  ENST ID: ENST00000566315
  CDS Start-End: 136-589
aggaagcgggggagagcggcgcgagaagcggcggccgcgtcctcaagccggcacctgagcggcggagacggctgtagcacaaggttgcatgatctttgaagttgaaagagacaatatttgggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcag

SEQ ID NO: 161372 - DNA, 583 bp, Homo sapiens
  Payload ID: 11509
  Gene Symbol: NUP93
  Gene Name: nucleoporin 93kDa
  ENST ID: ENST00000562496
  CDS Start-End: 175-583
actgcactccagcctgggcaccattgagcactgagtgaacgagactccgtctgcagtcccggcacctcgggaggccgaggttggcggatcactcgcggttaggggctggagaccggcccggccaacacagcgaaaccccgtctccaccaaaaccagtcaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagt

SEQ ID NO: 161373 - DNA, 410 bp, Homo sapiens
  Payload ID: 11509
  Gene Symbol: NUP93
  Gene Name: nucleoporin 93kDa
  ENST ID: ENST00000569322
  CDS Start-End: 1-255
ttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 161374 - DNA, 2875 bp, Homo sapiens
  Payload ID: 11509
  Gene Symbol: NUP93
  Gene Name: nucleoporin 93kDa
  Uniprot ID: Q8N1F7
  ENST ID: ENST00000564887
  CDS Start-End: 630-2720
atgcaagatgtcggaagtcatcaaagattcacatcagagtaattgcagtggtttgggttggggaaaaaaagtatcatagcattccttgcctacatgttgtctctccccctcttaaatcttaacttggtacagtccgttaacaataaaatacccttctgtaacctataaactgttactcccatcagtttgtgctttcaaactgatggctgacttctctgaatttgtgtagcgcacaacgaatggtgatgctgtgctccgggggctgcagtgcaccctttttaaagggaccctgcaatctcattgtttaatttgactctttagtgcttcagtcacatcagcacttgcagaggggttgttcttttcctttttcttctttctctctttttctcttctctctgtccttctccccacccccatccctcaattcaggcagtttggggtgggaaaaacttgagcactggttccgacagagctcatctcatataagaaggtttggaagagctgcagtgatcgacagcatcgaccgttctgtaactccttaaatttaagagctgcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 161375 - DNA, 477 bp, Homo sapiens
  Payload ID: 11509
  Gene Symbol: NUP93
  Gene Name: nucleoporin 93kDa
  ENST ID: ENST00000563405
  CDS Start-End: 1-354
agtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatgtaagtttcaggaaaggtgtttgaagtgcaggttaatgtacaccctcgaaaattcaaaacacttcatggaatttacttaaaacaaaggagctgttgccagtatgtttgttgtataaagaaagacaagtacaatcctgggacttaaaa

SEQ ID NO: 161376 - DNA, 2834 bp, Homo sapiens
  Payload ID: 11509
  Gene Symbol: NUP93
  Gene Name: nucleoporin 93kDa
  ENST ID: ENST00000569842
  CDS Start-End: 97-2739
ggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctggcctggctctgttgcccaggctggaatgcaatgacacgatctcagctcactgcaacctctacctcttgggctcaagccaccctcccacctcaccctcccaagtagctgggactacagcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgtatttc

SEQ ID NO: 161377 - DNA, 6973 bp, Homo sapiens
  Payload ID: 11510
  Gene Symbol: NUP98
  Gene Name: nucleoporin 98kDa
  Uniprot ID: P52948
  ENST ID: ENST00000324932
  CDS Start-End: 422-5824
aaccgcggcggcgaggggcgggactccacggccctctcaccgctcctaccctgtgcctccccgaactccttctgcccctcctcttccctctcgccccttcccccttcagttcggtttcaaaagacgcgttgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 161378 - DNA, 5628 bp, Homo sapiens
  Payload ID: 11510
  Gene Symbol: NUP98
  Gene Name: nucleoporin 98kDa
  Uniprot ID: P52948
  ENST ID: ENST00000355260
  CDS Start-End: 88-5268
tgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccc

SEQ ID NO: 161379 - DNA, 7023 bp, Homo sapiens
  Payload ID: 11510
  Gene Symbol: NUP98
  Gene Name: nucleoporin 98kDa
  Uniprot ID: P52948
  ENST ID: ENST00000359171
  CDS Start-End: 422-5875
aaccgcggcggcgaggggcgggactccacggccctctcaccgctcctaccctgtgcctccccgaactccttctgcccctcctcttccctctcgccccttcccccttcagttcggtttcaaaagacgcgttgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggt

SEQ ID NO: 161380 - DNA, 3923 bp, Homo sapiens
  Payload ID: 11510
  Gene Symbol: NUP98
  Gene Name: nucleoporin 98kDa
  Uniprot ID: P52948
  ENST ID: ENST00000397004
  CDS Start-End: 171-2933
ctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggcatttctggagaatgtgtgtatatacatgtttgcgcgtacaggggaggggagggtatgataaatgtgggaaactggaaatatattgacttttatgtttataatcttggtagcatttagaatgcccctaagaaatctccattgacaaatgaaatgctatagacttggttttccagttatccatattcattttgtctgtcatatgctttgtatcatctccttctttcctaattttttataaccttatatatatatttattataaatatatgtatttctgagggaaa

SEQ ID NO: 161381 - DNA, 3698 bp, Homo sapiens
  Payload ID: 11510
  Gene Symbol: NUP98
  Gene Name: nucleoporin 98kDa
  Uniprot ID: P52948
  ENST ID: ENST00000397007
  CDS Start-End: 177-2990
ggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggca

SEQ ID NO: 161382 - DNA, 939 bp, Homo sapiens
  Payload ID: 11510
  Gene Symbol: NUP98
  Gene Name: nucleoporin 98kDa
  ENST ID: ENST00000397013
  CDS Start-End: 1-409
cctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggtacatataaaaagcaggtttggctctcttaaagttacactgactataccacacgttattctcctgattcgtatgattggaaatatttaaaagttctcaggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagattgaaaccaacaaatccagcagcccagaaggctcttactacacctactcattataaactgacaccccgccctgccactagagtccggccaaag

SEQ ID NO: 161383 - DNA, 2541 bp, Homo sapiens
  Payload ID: 11510
  Gene Symbol: NUP98
  Gene Name: nucleoporin 98kDa
  ENST ID: ENST00000429801
  CDS Start-End: 1-2260
gttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttgcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaa

SEQ ID NO: 161384 - DNA, 536 bp, Homo sapiens
  Payload ID: 11510
  Gene Symbol: NUP98
  Gene Name: nucleoporin 98kDa
  ENST ID: ENST00000529379
  CDS Start-End: 1-536
agaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaag

SEQ ID NO: 161385 - DNA, 580 bp, Homo sapiens
  Payload ID: 11510
  Gene Symbol: NUP98
  Gene Name: nucleoporin 98kDa
  ENST ID: ENST00000533346
  CDS Start-End: 1-281
atgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcaggtactgtccacaccatccttgccagctgggcctaattttgccctaggtctggccaggaggcctcacatccagagacctgcccccgctcttgcagtgccagggccatggggctccggagccaccacctcagcctgggccttctgcttctgtttctactccctgcaggtatgaagctcagtacaccagccctggcctctcctggtggtgctactattcctgttctcccaaaatccctttccatgtagtctctcttgtgtttctcctcagtacctgttctgagaacaagctctctatttggggagtgtggaggagaggggtgctgaagtgcgtgaga

SEQ ID NO: 161386 - DNA, 544 bp, Homo sapiens
  Payload ID: 11510
  Gene Symbol: NUP98
  Gene Name: nucleoporin 98kDa
  ENST ID: ENST00000529063
  CDS Start-End: 1-226
ctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaaccttgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggca

SEQ ID NO: 161387 - DNA, 841 bp, Homo sapiens
  Payload ID: 11510
  Gene Symbol: NUP98
  Gene Name: nucleoporin 98kDa
  ENST ID: ENST00000524563
  CDS Start-End: 1-698
cagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagc

SEQ ID NO: 161388 - DNA, 553 bp, Homo sapiens
  Payload ID: 11510
  Gene Symbol: NUP98
  Gene Name: nucleoporin 98kDa
  ENST ID: ENST00000532475
  CDS Start-End: 182-553
agtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttgattttggaaccagtactagcagtggaggactctttggaaccacaaataccacctctaatccttttggcagcacatctggctccctctttgggccaagtagttttacagctgctcctactgggactact

SEQ ID NO: 161389 - DNA, 705 bp, Homo sapiens
  Payload ID: 11510
  Gene Symbol: NUP98
  Gene Name: nucleoporin 98kDa
  ENST ID: ENST00000527104
  CDS Start-End: 1-705
tggaagcagcacaaccagtgcaccttcatttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagag

SEQ ID NO: 161390 - DNA, 1795 bp, Homo sapiens
  Payload ID: 11511
  Gene Symbol: NUPL2
  Gene Name: nucleoporin like 2
  Uniprot ID: O15504
  ENST ID: ENST00000258742
  CDS Start-End: 260-1531
acgtaaccgttcaagcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccatac

SEQ ID NO: 161391 - DNA, 680 bp, Homo sapiens
  Payload ID: 11511
  Gene Symbol: NUPL2
  Gene Name: nucleoporin like 2
  ENST ID: ENST00000410002
  CDS Start-End: 49-516
atcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcagtccctaagccctttctgggctgaaacctagaccaccgggctttcccaagcccactctgggtgttcctgggcctccgtccttttgaggaaacagtgggtaccttgcaaatgggagctcttgcaatcaatatcgcagaaccttgggatctttcctctgtctcagttctagttgctcattttctgtgagc

SEQ ID NO: 161392 - DNA, 1329 bp, Homo sapiens
  Payload ID: 11511
  Gene Symbol: NUPL2
  Gene Name: nucleoporin like 2
  ENST ID: ENST00000413919
  CDS Start-End: 23-1329
ctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtggcaagttcattatctttctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaat

SEQ ID NO: 161393 - DNA, 1285 bp, Homo sapiens
  Payload ID: 11511
  Gene Symbol: NUPL2
  Gene Name: nucleoporin like 2
  ENST ID: ENST00000437140
  CDS Start-End: 21-155
ccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcagggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaac

SEQ ID NO: 161394 - DNA, 1653 bp, Homo sapiens
  Payload ID: 11511
  Gene Symbol: NUPL2
  Gene Name: nucleoporin like 2
  Uniprot ID: O15504
  ENST ID: ENST00000438012
  CDS Start-End: 63-737
gcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgcca

SEQ ID NO: 161395 - DNA, 249 bp, Homo sapiens
  Payload ID: 11511
  Gene Symbol: NUPL2
  Gene Name: nucleoporin like 2
  ENST ID: ENST00000548367
  CDS Start-End: 1-249
gtgatccatccgcctcagcctcccaaagtgctgcaactacagaaattacccaacagtcaatcccagaaatttttttttttgaggcagagtctcactctgtcacccaggctggagtgcagtggtgccatctcagctcactgcaagctccgcctcccgggttcacgccattctcctgcctcagtctcccgaatagctgggactacaggcacccaccaccacgcccagcttttttgtatttttagtagagac

SEQ ID NO: 161396 - DNA, 3036 bp, Homo sapiens
  Payload ID: 11512
  Gene Symbol: NXN
  Gene Name: nucleoredoxin
  Uniprot ID: Q6DKJ4
  ENST ID: ENST00000336868
  CDS Start-End: 93-1400
cccagcgcctgccgccgacgccgccgcctcctcccgccgcgcggaccgtggagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcaacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacacccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcatccaccctgggcctctgctgtccttgatcaca

SEQ ID NO: 161397 - DNA, 1340 bp, Homo sapiens
  Payload ID: 11512
  Gene Symbol: NXN
  Gene Name: nucleoredoxin
  ENST ID: ENST00000537628
  CDS Start-End: 599-1159
accggaaccgagcaacggtaactgtgccccttcaccggaaccgagcaatggcagacgtgtcccttcaccggaacccagcaacggtaactgtgtcctttcaccgaaactgagcaatggttaacgtgtttcctcactcagttcccaggcattgctgctgctgatctggggaacacactgtatgagcctgacataaacctctacagagctctgtctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagc

SEQ ID NO: 161398 - DNA, 2681 bp, Homo sapiens
  Payload ID: 11512
  Gene Symbol: NXN
  Gene Name: nucleoredoxin
  Uniprot ID: Q6DKJ4
  ENST ID: ENST00000575801
  CDS Start-End: 62-1045
aaacgtgccccttcaccggaaccgagcaacggtaactgtgccccttcaccggaaccgagcaatggcagacgtgtcccttcaccggaacccagcaacgctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcaacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacacccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcatccaccctgggcctctgctgtccttgatcaca

SEQ ID NO: 161399 - DNA, 1159 bp, Homo sapiens
  Payload ID: 11512
  Gene Symbol: NXN
  Gene Name: nucleoredoxin
  ENST ID: ENST00000571684
  CDS Start-End: 1-691
gtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgt

SEQ ID NO: 161400 - DNA, 452 bp, Homo sapiens
  Payload ID: 11512
  Gene Symbol: NXN
  Gene Name: nucleoredoxin
  ENST ID: ENST00000627182
  CDS Start-End: 93-452
cccagcgcctgccgccgacgccgccgcctcctcccgccgcgcggaccgtggagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaag

SEQ ID NO: 161401 - DNA, 452 bp, Homo sapiens; identical to SEQ ID NO: 161400
  Payload ID: 11512
  Gene Symbol: NXN
  Gene Name: nucleoredoxin
  ENST ID: ENST00000628478
  CDS Start-End: 93-452

SEQ ID NO: 161402 - DNA, 946 bp, Homo sapiens
  Payload ID: 11513
  Gene Symbol: NXNL1
  Gene Name: nucleoredoxin-like 1
  Uniprot ID: Q96CM4
  ENST ID: ENST00000301944
  CDS Start-End: 86-724
aaagatttctatttctgggagaggagccagtcagcagaccggggaccacacgccgcgctgtccccagcacccaacccaggttaccatggcctccctgttctctggccgcatcctgatccgcaacaatagcgaccaggacgagctggatacggaggctgaggtcagtcgcaggctggagaaccggctggtgctgctgttctttggtgctggggcttgtccacagtgccaggccttcgtgcccatcctcaaggacttcttcgtgcggctcacagatgagttctatgtactgcgggcggctcagctggccctggtgtacgtgtcccaggactccacggaggagcagcaggacctgttcctcaaggacatgccaaagaaatggcttttcctgccctttgaggatgatctgaggagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtaccgcgtggaaaaggcggcgcgaggcgggcgcgaccccgggggagggggtggggaggagggcggggccggggggctgttctgacccgctagggtggaggagaggagtggggtttgttgatgaacctccacccccaccccacccccgcacgcctgtaatcccagcacttggggaggccaaggcgggaggatcgcttgagcccagaggttcgagatcaacctgggcaagagagtgagaccctgactctacgaaaattaaaagttagcccggtgtggtggcgcgcacctgtggcttagctaccctgaa

SEQ ID NO: 161403 - DNA, 805 bp, Homo sapiens
  Payload ID: 11514
  Gene Symbol: NXNL2
  Gene Name: nucleoredoxin-like 2
  Uniprot ID: Q5VZ03
  ENST ID: ENST00000375854
  CDS Start-End: 335-805
aggagtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcatgagctgaggaagaggtacaacgtcacagccatccccaagcttgtgattgtgaaacaaaatggggaggtcatcaccaacaaagggcggaagcagatccgggaacgggggttggcctgcttccaggactgggtggaggcggccgatatcttccagaatttctccgtttga

SEQ ID NO: 161404 - DNA, 1457 bp, Homo sapiens
  Payload ID: 11514
  Gene Symbol: NXNL2
  Gene Name: nucleoredoxin-like 2
  Uniprot ID: Q5VZ03
  ENST ID: ENST00000375855
  CDS Start-End: 331-738
gtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcaacggagtctcgctctgttgcccaggctggagtgcagtggcgtgatcttagctcactgcaacctttgcctcctgggttcaagtgattctctagccttagcctcctgagcatctgggactacagccattgctgtgaattacgtgagggaaagatattgaagaggagttggacactccgagagtgcagctgttctccccccgcaccatccgtgtcctgcattctgcgagtctgtgctcattaacaatgtgctgtgaccatgtgactcagcaatcctgctgctgggtatatacccgaaagaaaggaaaaggaagccagtatattgaagaggtatctgcacccccatgtttattgcagcactgttcacaacagccaagatttggaagcaacctaagtgtccatcaacagatgaatggataaagaaaacgtggtacatatacacaatggagtactcttcagccattaaaaaaatgagattctgtcatttgcaataatatagatggaaaaggaggcccttatgtgaagtgaaataagccaggcacagaaagacaaacatcacatgttctcacttatttgtgggatctaatgatcaaaacaattgaactcttggacatagagagtagaaggttggttaccagaagctggaaaggaaagtggggttgggaggaaggtgggaatggttaataggtacaaaaaaatacaaagaataaataagacctaatatttgatagcacaacagtgtgactactgtcaataatcatttaattgtacatttaaaaataactataattgcattgtttgtaacacaaaagataaatgcttgagggga

SEQ ID NO: 161405 - DNA, 739 bp, Homo sapiens
  Payload ID: 11514
  Gene Symbol: NXNL2
  Gene Name: nucleoredoxin-like 2
  ENST ID: ENST00000618633
  CDS Start-End: 335-739
aggagtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcataaagtttcgctcttgttgcccaggctagagtgcaatggcgcaggctcagctcactgcaacctctgcctcctgggttcaagtgattctcctgcctcagcctcc

SEQ ID NO: 161406 - DNA, 1762 bp, Homo sapiens
  Payload ID: 11515
  Gene Symbol: NTPCR
  Gene Name: nucleoside-triphosphatase, cancer-related
  ENST ID: ENST00000366627
  CDS Start-End: 72-758
ggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaattcaccgtactgtgtcatagaagaccagagcaaattctccagctgtgtatcacagtccactctcacagagcctggctggaggcagaagctactgcaatcactgctgaactcagagtggaagaaaagggcccctgtggtgcccacctctgtgtcgcctcctttctacctcaggtggattccttgaatgcaaacaacaggaatggactttggctaacttaagtgaaaacagcatcaaaaagccttataggctttggagctgtcccatgaagccaaaggaaaagctgactgtcctcatttcaagtggagccacagccgcccaggattgacgcagccaggaccagtagaaatgggatcacaggattgacgcagccaggaccggtagaaatgggatcacgggactgacgcagccaggaccagtagaaatgggatcacgggattgacgcagccaggaccagtagaaatgggatcagcttctggcacttgctgcgtgagctcactcctcttggggtgcagatctcagtcactcctcttggggtacagatctcagagaagttgccagggcctggcttgcccacttgttggctgggggcaagtttcctagaccgtacagtctcctaaagacaaccagagcactcttccaagaagggtgagcaggtgccaggaaccagaattgacgaggtccgctctgcatctcctcttcagacatgtattggcacctattgtatgccaggccccctcttcagatacaaccaccctgaacctcagaaggcttccacatgcactccctgctcttaccgggaaccttggctcagccccttttccatggttcacctgtcgaaattacatccaggcttaagcacccctggaagcctttcctgcccctgaccccacacatgcccctgttcctgcctgccccccagactccttcattgtccttgttcatgcctgtcctgtcctggtctgcgagctccatgaggtcagggtccttacctgtggtgcttctctatgcgcatctctgtgcctggctcctgtttgcccttccaccccatcagcgtgtgttgagtggatggatattatatgggccaagtaggaaggcactgtgatgggagcagagatggcccttcctttaccctggggcactcgggatggtgtggtagtgaaagaaaaataaacagatcatcgggtaaa

SEQ ID NO: 161407 - DNA, 6311 bp, Homo sapiens
  Payload ID: 11515
  Gene Symbol: NTPCR
  Gene Name: nucleoside-triphosphatase, cancer-related
  Uniprot ID: Q9BSD7
  ENST ID: ENST00000366628
  CDS Start-End: 88-660
gtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaggcattgtgtgggaggaatacacaacctttggaagtgttgatagcatctgatattcagccgaccagatgacaagagctcaggcccacgggtttgcataagagcactgctttgccttagtttactcgggagcaattttgaatctttctatgcctagtttcccttccagaaaagcaggaagtggctgtcatctcaggagtgatgtcacaccacagaaggaaactgtcaaccactccacacaactgtggagagtgcccagtgccaggggctgggcttatcaggaataatggtgtagcaatgcggagttcagcccataacaggggtactataaaaatgaagtaggaaagtagaagagacccctgaaaccccagaactgatagaggataaaaacttccctccaagtggtagatggtactggagtgataaacagttcagtgtttttaggtcatttttggtgaagatctatgaatttccaggatttttttttaacaaattagcattggctacaaacccactggtataagcagcagtgtgccttctctctaactgtggacaagtcgggcatgtggcgggtgaggagccctgggctgggcactggggcacagtgaatggggcgggaggggctcacatcaaaaccaaaatggcacgcagcccaggtctggttcctccatcagtgtctctttcctcagcgcttttcttccgaggtaactttgtgaagcttgacttggacttgcctagccttggagggaccacaacagggaggcctaatagattatgaactaagccctcaaaagggctacctgcccaggaggaggaagtgggcatctccttccacagtccctgcctggcggggctgttcagggagactgagttccgagctcaggatgtctggcaggctggctgtgacttccagccaccatcaccaggacaccggtgtgggctgcatgcctcagtgggccaggagaggcacggcctctgagttgggtagaggcttcccacaaaggcctgggaacctgatcctggccgtaaatctgaaagtaccacagccctcaggagaaccaagagatagggaggcaggctggggaaatgtcatcaatgtgcacccaggcgtggtggagctggtcagccccagctggagtgggaccccatcaagatggagcctttcctggcacctccgggaggccgttttgcgtttccgcccttcatgcatctgaaacaccaagggccatgttccttctggtgcttgtccttttgagcttggtgtttcagccgtgtctgttttgtagactttgattttgtcttaaatgagaaagaaagctggtgaaggttatttcaaagttaaatagctagtctgaggggcttatcactgaagccagttgtgcttatgtggggtgggagtgtcactgcctacttgaaagtatgcacttgtgtggaacagattcagggtggcccctagcacttggggctgcgggagcttctgcacactttccctttaacggtaaagagacaagcttggagtgtttaagtggttcgttcaggagcacagtgatagcggtgacaaaggagatttgaacccacgtctgcgtggctccaaagttcactctttcatcactccctgctgcgtccttcttgaggctttagcatttttagtgtgttttgtgcccccagacctcagagttgacatttagcagtgataaactgctgtaaatccaaagaacgtttagtgtctcttgtggtgaggtcctgaaatgattgttgtattagtcaaacagaatgatcatggagcatgtatggagatgtcagatgcaatccctgtattgtaaggcaatgacatttaatgaaggataagatgaattcacagataactagaactcagggccaaacgcacacagcctgtagcaacagtgtcatgctgagatttaaaggaagaagaggtgccgtggcagaactccacgtgaccgtcccctccctgcacgcagccaggatgagaggagcagagctgagcgccacctccctgtcggtgccacggctgaggtgaggagctcttgccggatggtggggtgggggcagcagggcagattgaagtcagggattctcttatacctgagtttggaatgcctcctattcaaacaaagcaaaatatctaacagatggttggatatgagtctcagggaggaattcaatttgaaaagcacagaattaacatgtattgcttatatgaagaatctcagctagaataacaaggtcggatgggaggaatcaggactgatttgaagcacgatttactaaatcattctttccttttcctccttagcagatcataccgccagctgcttaacacgtaatagtttaataaattgtttcttcttacctctcagtgagggtaagcacatgcagggagatgggtgagtcttttaaatggatagtgtcatctctgatgatcagccttgacagggagagatcctagtaaagctgcaaattcaggcactcagttcccagccctccagttatcaagggggtgggaacgctggtgggctggaaaatgtggaacagacctgctcctcttcttttcctgccaattaccgtattcatagaaggttgtgtctgtggatcacacctgtgtgtgtgctgatggcggatgcttgtgtagcatagtgacttgggacaaaacagcatggtagatgaggctggagacgggtgggctaagtaaacaggcattgcattgcacattttgtgggcaaagaagttgaagcatcgcatgattttaacaaattacttgccagatgatttcaacacactgcaaaatttagaatcaataatgccaaattggccacatgatttatataaaaccaagtgctatggttttaatattatctttagaggagaaaccattttgatctgtgtccaaataactcttttttttttttttttttttgagacagagtctcactctgtcgcttgagctggagtgcagtggtgctatctcggctcactgtaacctccgcctcctgggttcaagcgattctcctgcctcaacctcctgagtagctgggattacaggcacccgccaccacgcccagctaattttttgtatttttagtagagacggggtttcaccatgttggccaagctggtctcgaactcctgacctcatgatttgcctgcctcagcctacaaaagtgctgggattacaggcgtgagccaccgtgcccagcccccaaataactcttgaactggaaaataactctttagctatatactggcagaatatttgaacaactctagcaagaaatgtcagtttagggatgcctcctctaaatgggggcttagaatataacattttgcaggaagtcctttctgatacatagctgactagatgaaggaccagattaacaagttcatgagttgtaaatataaaagttgtgtaccacgataaaaaagaaaaagaagtatggctgcactgttgatggctggtcaaacagcccccaagaatcctggggtgactccaatactgccaccttttctctgtgggtgcagttgcctgcggatgtgtgtgcacatctgtgcctcggtatgcacactcgagatgcccgctctcatagacggtgcagagcgtcactgcattcctatctgattaatgtgaccttagtgttgtagatacactgtgtcactttcatcctccctcctccccacaaaagatgccacgagaactcgtgaactgtgataagcaatgaacagaataactgttgaagaagcacctcatgaacctccccagagaaacgggatggaggagcacccagggtgctcttgctctcttgcctgcgctgccatttccttccagcctgggtttctagctctttggggagattccccgttttgtggaatgctttctgtgtttcctacttctggatgcctaaggagtggccagtcatactcctggctgaccactgccaggcaccgtggttttcctcactgaactcaaggagtcaccctccgtggggaggccacactcacagctccaggcctgccatttagcccttggggcttggctgtaaagttgcccaagaggattacaggagctgccagccaagtttaatttggccaccttagagaactgcagcaaggccctatcagcttcccattagacaaacaactgcatttaaattaaataaagtttgcacctctagggagtgctgacctgaaaataagaaccttctgtctgtgattatagagtacacttgcttttattaattgctgattcttagtttacaaaaaaaaaaattagaaaagcattaccatttactttccaaggggcaagagattctctacaatacccttcccccaaccctctcctcaaatttccaaatcctaaatactttgaagaaatttgtgtgactgtttaaaattgagtatttccttctaactattgtcttttgaaaagggatggttcaccaggccagtgatactctatggactgcattttgggacctctaccccagcaaggatacaggttcctggggtcttgaagatgggaaaagttgtctcagaatttacccaaatgtcgttctcaccataaaagatatacttgtagaaatgagaagcttcagtataactcaaaacactggacgcagcaataactataaacattttaatttcaaaaacaaaggtgtgtgcgatgttgtgtgcacagtaagggttgcggggcttggagaacaagcacgcgtccctgtgaagcccgcagggtgctggcggcccaccaatcgcctggactacagtgaggagcattgtgtgactccgcggtggatttccatgcaccgaatggactcagtttctaaactcacatcctaacgtatcctggcttttcacagaatactggagacatgactgcatgcatgatcacggttcttgttgtgaagctgccaccatgttacgcttaacagctgcataaatattataaagaaatagggttttcttgacacttagatttaaccttaatgcatctgcccagctgatggtatcagacgtgctgctgttcatttctttttcatggtaacagtaatgtataaagtgccgatgatgtaa

SEQ ID NO: 161408 - DNA, 4441 bp, Homo sapiens
  Payload ID: 11516
  Gene Symbol: NAP1L1
  Gene Name: nucleosome assembly protein 1-like 1
  Uniprot ID: P55209
  ENST ID: ENST00000261182
  CDS Start-End: 413-1588
aaaagatatggtggggtgcttaacagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctgg

SEQ ID NO: 161409 - DNA, 1896 bp, Homo sapiens
  Payload ID: 11516
  Gene Symbol: NAP1L1
  Gene Name: nucleosome assembly protein 1-like 1
  Uniprot ID: P55209
  ENST ID: ENST00000393263
  CDS Start-End: 121-1296
tcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaa

SEQ ID NO: 161410 - DNA, 2031 bp, Homo sapiens
  Payload ID: 11516
  Gene Symbol: NAP1L1
  Gene Name: nucleosome assembly protein 1-like 1
  Uniprot ID: P55209
  ENST ID: ENST00000431879
  CDS Start-End: 226-1197
cttttttagcgccatctgctcgcggcgccgcctcctgctcctcccgctgctgctgccgctgccgccctgagtcactgcctgcgcagctccggccgcctggctccccatactagtcgccgcaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaat

SEQ ID NO: 161411 - DNA, 1597 bp, Homo sapiens
  Payload ID: 11516
  Gene Symbol: NAP1L1
  Gene Name: nucleosome assembly protein 1-like 1
  ENST ID: ENST00000544816
  CDS Start-End: 509-1135
gtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgttt

SEQ ID NO: 161412 - DNA, 1675 bp, Homo sapiens
  Payload ID: 11516
  Gene Symbol: NAP1L1
  Gene Name: nucleosome assembly protein 1-like 1
  ENST ID: ENST00000542344
  CDS Start-End: 227-1276
ctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggatta

SEQ ID NO: 161413 - DNA, 1686 bp, Homo sapiens
  Payload ID: 11516
  Gene Symbol: NAP1L1
  Gene Name: nucleosome assembly protein 1-like 1
  ENST ID: ENST00000535020
  CDS Start-End: 67-1218
actgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtt

SEQ ID NO: 161414 - DNA, 892 bp, Homo sapiens
  Payload ID: 11516
  Gene Symbol: NAP1L1
  Gene Name: nucleosome assembly protein 1-like 1
  ENST ID: ENST00000547529
  CDS Start-End: 1-532
aacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaa

SEQ ID NO: 161415 - DNA, 760 bp, Homo sapiens
  Payload ID: 11516
  Gene Symbol: NAP1L1
  Gene Name: nucleosome assembly protein 1-like 1
  ENST ID: ENST00000547704
  CDS Start-End: 139-760
ttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggttagtaccaactttattttggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaag

SEQ ID NO: 161416 - DNA, 818 bp, Homo sapiens
  Payload ID: 11516
  Gene Symbol: NAP1L1
  Gene Name: nucleosome assembly protein 1-like 1
  ENST ID: ENST00000548273
  CDS Start-End: 190-818
ctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccaga

SEQ ID NO: 161417 - DNA, 1009 bp, Homo sapiens
  Payload ID: 11516
  Gene Symbol: NAP1L1
  Gene Name: nucleosome assembly protein 1-like 1
  ENST ID: ENST00000552147
  CDS Start-End: 1-597
actgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaa

SEQ ID NO: 161418 - DNA, 1526 bp, Homo sapiens
  Payload ID: 11516
  Gene Symbol: NAP1L1
  Gene Name: nucleosome assembly protein 1-like 1
  ENST ID: ENST00000552342
  CDS Start-End: 114-1253
gccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcgattccagcttcttgtttgggtgaattttccacagaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagt

SEQ ID NO: 161419 - DNA, 1838 bp, Homo sapiens
  Payload ID: 11516
  Gene Symbol: NAP1L1
  Gene Name: nucleosome assembly protein 1-like 1
  Uniprot ID: P55209
  ENST ID: ENST00000549596
  CDS Start-End: 140-1246
cttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagt

SEQ ID NO: 161420 - DNA, 851 bp, Homo sapiens
  Payload ID: 11516
  Gene Symbol: NAP1L1
  Gene Name: nucleosome assembly protein 1-like 1
  ENST ID: ENST00000550934
  CDS Start-End: 140-851
cttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaag

SEQ ID NO: 161421 - DNA, 1967 bp, Homo sapiens
  Payload ID: 11516
  Gene Symbol: NAP1L1
  Gene Name: nucleosome assembly protein 1-like 1
  ENST ID: ENST00000547773
  CDS Start-End: 184-1170
gctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgttt

SEQ ID NO: 161422 - DNA, 460 bp, Homo sapiens
  Payload ID: 11516
  Gene Symbol: NAP1L1
  Gene Name: nucleosome assembly protein 1-like 1
  ENST ID: ENST00000551524
  CDS Start-End: 118-460
gccagttaggaaaacttcatgagattggattgtcctattaaaaaagcataatacattttcataaaatccttctttcgatgcccttttttttttaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgaga

SEQ ID NO: 161423 - DNA, 1074 bp, Homo sapiens
  Payload ID: 11516
  Gene Symbol: NAP1L1
  Gene Name: nucleosome assembly protein 1-like 1
  ENST ID: ENST00000551992
  CDS Start-End: 283-1074
ggcggaggctgcgaattccgacgggagggaggggctgtggagggacgagtccccgaggcggggagggggcgggggaggctgcgacgctcccgggctctccgcccattgggggcggccgcgcggggaggggaaacccccggcggcttcgctccacacgtggtaatgggcttcatggccactggctgggcctggttggagacccttgccctcggtctgtgcttactttgaaagttgtagagacggtggaatgtgaaaaggaaggatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaa

SEQ ID NO: 161424 - DNA, 786 bp, Homo sapiens
  Payload ID: 11516
  Gene Symbol: NAP1L1
  Gene Name: nucleosome assembly protein 1-like 1
  ENST ID: ENST00000551600
  CDS Start-End: 140-786
cttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggctgaggattgttgccattttcaagtgaagacatggaggcttctaagtgacttgcccacaatgaataatggcagagctgtgacacacattcagtgctgtgaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctat

SEQ ID NO: 161425 - DNA, 623 bp, Homo sapiens
  Payload ID: 11516
  Gene Symbol: NAP1L1
  Gene Name: nucleosome assembly protein 1-like 1
  ENST ID: ENST00000547479
  CDS Start-End: 140-623
cttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagggtctcattctgtcagccaggctggagtgcagtggtggtgcaatcttgctcaattcagcctcgacatcccaggctcagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaac

SEQ ID NO: 161426 - DNA, 1339 bp, Homo sapiens
  Payload ID: 11516
  Gene Symbol: NAP1L1
  Gene Name: nucleosome assembly protein 1-like 1
  ENST ID: ENST00000548044
  CDS Start-End: 207-1190
tcgcggcgccgcctcctgctcctcccgctgctgctgccgctgccgccctgagtcactgcctgcgcagctccggccgcctggctccccatactagtcgccgcaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggttt

SEQ ID NO: 161427 - DNA, 1981 bp, Homo sapiens
  Payload ID: 11516
  Gene Symbol: NAP1L1
  Gene Name: nucleosome assembly protein 1-like 1
  ENST ID: ENST00000552056
  CDS Start-End: 1-1158
aaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagt

SEQ ID NO: 161428 - DNA, 13505 bp, Homo sapiens
  Payload ID: 11516
  Gene Symbol: NAP1L1
  Gene Name: nucleosome assembly protein 1-like 1
  Uniprot ID: P55209
  ENST ID: ENST00000618691
  CDS Start-End: 488-1663
cgggcgccgggcacgcgggccaggccttccccacaactgatggggttgaaatttcctttccggctcagcagggagaaaagatatggtggggtgcttaacagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaagttcttggactgattgaggatcacttacatgactttacagaaatggaaacatccttgttggtatatgaaattattttactcaaggataagtattcataagaaattttgattgatgtatattttcaaaaatacagtatgctttgtatcttgtgtttcttccttttgacatcatattgtcaggttttccagtttacaaaaattaagttattcactaaaatcttagtacagacagtccctgacttataatggtttgacttaagacttcagctttatgagtttattggagtattaaacacatcttctacttatgatatttttgacttacagtgggcttattgaggcccgaccatgtcatcctcaagccaagagtctgaataaaagaagaaatggggtatttagaaataatagattactggcgggaaataagtcagtctggttgtttaattttcctatgggaaattgggcattttaagttttgtggatcctagaacaaactgagttttattattttgaaacccaggataaaatattacataaaagcattgctttttagtttcttacatgttttatccatttatttttatttttgagatagagtcttgctctgttgcccaggctggagtgcagtggcatgatctcggctcactacagctgtcatctcccgggttcaagcgattctcgtgcctcagcattccaagtagtcgggattacaggcgtgtgccactgagcccagctgatttttgtacttttagtagagatgggttttcaccatgttggccaggctggtctcgacctcctgacctccagtgatcctcccacctcagcctctcaaagtgctggcctctcaaaagtgctgggattacaagcatgagccaccacgcccagccagtttcttacatgttttaaacttaaagccaaaaagaaggaactaggaatgtgtgattaaacgtgagtgccagaagtcgacagatctcatatccagagttgaaggtcttattcataattttatcattcataatgtattaggcaattgcggctctggtaaatttcatgaggttgtaaaatagttgctaccagaaggctcaaaatttgtatgagcttttagctgagattttgagaatctgtaggaatttgtgaagtgagaggaagaacctctgaacggtgagcagttcaggtggaggaacaggaggaaatacaggcaaaggtcccagaacagaacaattgaggctacattcaaggaattgagatacctggaaatacaggtagaaatacaagtggccagtccatagaaagtttagctgtggaagtcctcttaatgggtttaaaacactggaaccacctgttacaagagtatttcaagtgaggatgaggatgaccattccatgtagaaatttttttttttttttttttttctgagacagggtcttacttcatttgcccaggttggagtgtactgctgcaatcagcctctcgagtagctggtatcacaggcacgtgccaccacgcccagctaatttttacatttgttgagaggtgtttcaccatgttggccaggctggtttcgaactcctggactcaggtaatccacccatcttggtctcccaaagtgctgggattacagacgttagccactgcacctggctgaaagataatttttaaaggaagacatgattgatagaccaagtcagccatttgaaggtcagaacatttgaggtaggtgggccccaggggccagtaaaggcttcagggtcatatatatgcaactgaaaaagtaagttaaatgacgtggcagcagcagtgaacaagacgctgttagctgttaagataatttacttagccaagaacaaaagctttatttaaaaaaattgctgaataaagttttatctgcagtgaatccccttagtcaaactccagattggtgttttggggtaacttatcaatattacagctttccttcaactctgaaaatagttgaaagaattccggtatattctttactctgatcaacatactttttggctcaaaaagttttctagtcttacaggcgttttctatttcagccctggaatgggccatttctccaaggattgctggcttcttagaatagggagtattacttagaaacttaagtccagttgctgaatatgctctttacagggtatttctagggcctttcaggtgaaagaaaatttgtacatgtatcataaaaactgaacgcacagtggatactttgaagttgaatcaaacaatgttatttttcctactgctactgccgtccgtatttgtaattattttcaaataagtggaatcagttgatccaactaggaaagtagatgaggttgctctataggaataagaatccatgaataaaaatggagatctaattttagactaaaacttttcagcccctaaacaaatgtctctgctaccaaattttaatggatatgtgtgagaatacaagtagtgtctttgggtagtgtctttaaacacaggctttagagtctgtctaccacctgttggttcagcatcagtcttttcatctgtattgcgaaagatcgtggtgaacattaataaggaaacaaaagtacttagagcctatgagcacttcctaaacataagaaaacctaaaatttgtgattgggattactttttaaattggttttagaactttatttctgaactagttggggttttcttggttcaaaggcaaaattcctcctaggtgtaagggatgcattactcagtgtacataagaacactgagactaagactggataataaaattaaacatatgcctcgttttgaagattttatgtgtaaaaaacaaaaaaaaaattgaccttaacctaaagtgagctaggtttgaaaatctcatctcattcctttcttgttttattttaatacatgtgttttcatatgctgtttactttctttggcctttggcagaacccagaaatgatctagggtaaaacgaaatgaggtatcgctatatatttggatttctcatgcttcagaatacccaaattgtcattattcaggttatcccttctatctcccaacatttacctggagccttgacactggtgtggatgtgacatgggtgtctgtcttgagatcagatgtgattttagacttggattaggccagtcaacaaagttttatttttattatctttgagatgattctcactatgttgcctggactagtgtctaactcctgggctcaagtggttgtctcacctcaacctcctgaggtgctatgcttacaagtgggagctgccgcacttaactatggatttcaaaactggaggctggaactgttgtctttgctattcatttggcttggtgagtggacttagccacttcacggcaacttggagatgaatagcccactgtatttaacctgcatttgcactatttcagctctgcttggctgccttttcttttacttctgccactgggcttttgtgcatgtgttttactagttcaacataggatctccttttcatcagtacctactctttggttctataaatctgaactggttttgaaccagttcaaaatactctagaaacacttgcttattaatgagtttcctaatttccagcactgtgcttggaacttggtaagtgtacagaaaagttttggatgtataggtcagttaggatttatctagacccattcaatgtaccaaccataatcctgtgtgggactgtgtagcaagtcgaatgattgattctcagtagttcagtctctaaggtcttttgtagttgtcatattcctgtagattgagaaaaccaatgaaacaaagctggattgtgtatacagttagctctttcataatgcaggggctaggggccccagcttccttcagtcaaatctatgtataagctgattcccccaaaacttgacagcctactgtggaaactttaccaataagtcatttaacacacactttgtatgttatgtgtattatatactgtaaaaagtaagctagagaaaatgttaagcaatcggaaatatattatggccaggtgtggtggctcatgcctgtaatcccaacactttgggaggctgaggcgggccagtgacttgaggttacaagttcgagaccagcctggctaatatggagaaaccctgcctctactaaaaatacaaaacttagctgtaggtggtagtggtgtgtgcctgtagtccaagctactcaggaggctgaggcacaagaattgattgaactctggaggtggaggttgcagtgagcccacaagaattgactgaactcgggaggtggaggttgcagtgagccgagatagtgccactgcactccaacctgagcaacagaatgaaactgtctgtgtgtgtgtgtgtgtgtatgtatatgtatgtgtatgtatatttactctcaggtggaactggattataacagtctcaatcctcactgccttcatgaatagctgaggaggaggggggtcttgctgtcacaggggtagtagagacagaagtaaacctgtaagtggaccctcttagttcaaatttgatattcaagagtcaacttagttgttttttaaagtcaagggaaggcatatcaatagttgcagttacctagtactgcataacaaaacaacctccaaaacttaatggcttaaaacaagcaaaatttttctgactgggcttagtttgttgcagtcgttttccaaaatgaccaaagacatcaaagcttaaattacatattgtatgcctgttcagggagaaaaacatatgcttttccccatcattttggaatcttttacttgaattatagctggacaattgatttccagctataattcaagctataacgtagtgaactccctcagacaaaaatgtcaagcttgattagtaaaggaacctcaagtggtatgtataaggtgacccttaagtacacgtgttttcaaaagttgggtataatgtaactagactgagaggtttcgagaaaaacttcattgctattccatgtatagttttaaactagtgggatttcagtttacagtattaatcagcaatttggggagaactaagtgttcgtttaacattaagataataaaaataatgccttaatcatacttgattgagaatattaattccctttttatgcataaggatggaagttaagtaactttaacaatgacacagttgagttgtgttggagccagcatttggatggccctacactttgcactgccttgtagatatttctgtcacacaactagtggttaaataagcatgttctttaggctagagctttcagagatgaaatattttagagaccagagttaatctagatttcattttaaacaatattcagataatctttcctttttctctcccctgccctgaagagtttgtatttattataatgttgtataacacagccccaatacaatgtggcttatataggtttttctcttaggcttagacagactctgggactgatatgggagcttcatggttctcaggcagactttcattctactttttgtctttggcaagttggtttattatcaagtggttgctggggctctatacatcatgtccaggttcaaggtacaggatgggctgaaggaggctaaaggctactggcatccaacctctcctgtaaaaagaagaacctatggtttatgctcacagtgctaaaagtaggatagtaaataaaatagagctgggtgtgaatgccaagggaggttaggatgacagccacattggccacatatgtcgaaataagttgatttagaaaaggattatttgatcaaggatatcctggaacataaagcaaataactacattttagaaataagtgaacagggctaagaaaagtaattttctttaaatacggcccaaaaggattaattatgattggagtcctgctttgcccaaggctttttatttcattttgcatgataacctttctcagaaccatgcatgcacaaattaggttgagacaatgacttaaaagtgtaaatgaaatctcattagaaacaaaaactttctggtttctgacatgtttaaggggtgctcattgttactcaacaatgatttacttaggtagttattgtgatgggggcggttctaatgggatttctttttctggtaggtttagtggcaacatacaagcttgccataaacatttcctgggttttatcttcttgtaaaagtgttattccacctttctgagtctggctaccccacagaattcttttatcccttttactcttagattaccttgtctgtaatgaaacttaccctctctgaagcctgagttgttcttctaaagtaacaccactaccaccttctttattctcatgtttttgggaggaattgtctacactcactgctatatgtcctctatcacctaagaaaggtatttgcccattactggatttttttttcttacagagatcaatagtgatcaaattgaacagcctatgtcctcaggctgtgtgttttgtggcaatggaaaaatgacagcaaaagagggaaatatccttggaatttagttccttaaatggaggtatttgcccaagtgactgtcagttacatatttgagttgcaaacaacgggttgcatttaccgggtttcagagtagaagcatacttaggaaaggtggtaggtgttcttgggctcttcagtggggacagaggattgcttccactcttagttactggggtatcttgtcaccccagagacccagagccagaatatcaacacttttgagtgattgcagttttgtgacaacataatactggttctctcagcctccttcattggattaccttcctctctgctccatttcatccagttccatattttcgtttgtcacttcaaagctaatattaccataacaagtttacaaataatcagacttcctggttacttgttaatactcaataagatagcctgcttgcccattttgaataatatcaatacatttccagacaaaacattagtcatttcccctcagtttaagtgctgtcaatcagctctccgttaggtacaatggcgaaaacactcatccaggatcttggatatttagtgaagtagacgtgaaaattggataactactcatcagagtttgaagtgattaggaaggaattaactcagccagaggaaatctgggatttgaatagggctttgaagaatgaaaggtttacagaggatttgggaaggtaaattggaggctgcgaggacaaggagatgtatgactggcactcgctcaaggttgagtggaacgagtcaaaataagtaggacccattctgtggagggcttgtcatgcaagggtaaggaattggaatgtatacaattggaggcgaatagaagttttctgtcatgttttaagagtaaaactgaaggccatgtgtatgagtatggatcaggtgattgggccacccaagaacttagatgagagaactgaattaggctgctggcagaacagaaaggacggagacagctgatggacggtgcttggatccacaattgtgtttgtactacagttaaaaaaaagcgctaagcactcattataaagcacttgctttaagctgttacacagattggtcactaggaggcatcagttcatcaactactaaggcgaaaaggaaggcagctctggacacccacctaagaagtctggatagttctgtgttaatacttaacgttttcaactcaaggacttttggaaactagaatctagaatatttcttctgaatagtacttcaaagatgaaataaggctaagaagtctaaactgcactctgtgagactatttgtttatttatttaattatttattttgagacagattctcgctctgttgcccaggctggagtgcagtggcgtgatcttggctcactgtaaccttcacctccctggctcaagcaattctcctgcctcagcctcccgagtagctgggattacaggcgctgtgggttttttttttttttgtatttttagtagagacggggtttcaccatgttggccagacttgtgtcgagctcctgacctcaggcaatccgcctgcctcagcctcccaaagtgttgggattacaggcgtgagccaccgcgcccagccttggttatcttttataccctgatgagggtaacgtgacatgttcataatttactgggctttaactttttcttgaaagatgtttgacctttggtctatccaaatctttaataatgatcattgtcatgagtttctactgtatattgcaaattggtttacagatcagaattttgtaatcattatgaattaaacacttaataactttcc

SEQ ID NO: 161429 - DNA, 2550 bp, Homo sapiens
  Payload ID: 11517
  Gene Symbol: NAP1L2
  Gene Name: nucleosome assembly protein 1-like 2
  Uniprot ID: Q9ULW6
  ENST ID: ENST00000373517
  CDS Start-End: 357-1739
tgatagctgcgtaatcatactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaaggagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggaggaggaggaggaggaggaggacgacattgaggctactggagaagagaataaagaagaggaggatcctaagggaattcctgatttttggctaactgttttaaaaaacgttgatacactcactcctttgattaagaaatatgatgagcctattctgaagctcctgacagatattaaagttaagctttcagatcctggcgagcccctcagtttcacactagaatttcacttcaaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctcaaatggaagggatggaaatgatgattttttacttggtcacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcttgtattttatgtaactgtgataaataatgaaacttagttatattgaggttattgtttgtcggtgaagtgttagtcacagtattttcaaaagtttgcacatattgttctgtgtaattgtgtaagccataattacagtgtttaattctcttttcctattacatcattcattgaaagtgatcactttaccattttgaaaagatatttcgtgttctttcactgcaaaataaaaagaataaaaatttcagagtgtctcatgtttaaaa

SEQ ID NO: 161430 - DNA, 2639 bp, Homo sapiens
  Payload ID: 11518
  Gene Symbol: NAP1L3
  Gene Name: nucleosome assembly protein 1-like 3
  Uniprot ID: Q99457
  ENST ID: ENST00000373079
  CDS Start-End: 265-1785
attcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccacctccgcagcccgggcctccgccgccgccactcaagcatccgtgagtcattttctgcccatctctggtcgcgcggtctccctggtagagtttgtaggcttgcaagatggcagaagcagattttaaaatggtctcggaacctgtcgcccatggggttgccgaagaggagatggctagctcgactagtgattctggggaagaatctgacagcagtagctctagcagcagcactagtgacagcagcagcagcagcagcactagtggcagcagcagcggcagcggcagcagcagcagcagcagcggcagcactagcagccgcagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactataaaaa

SEQ ID NO: 161431 - DNA, 2555 bp, Homo sapiens
  Payload ID: 11518
  Gene Symbol: NAP1L3
  Gene Name: nucleosome assembly protein 1-like 3
  ENST ID: ENST00000475430
  CDS Start-End: 207-1706
attcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccacctccgcagcccgggcctccgccgccgccactcaagcagattttaaaatggtctcggaacctgtcgcccatggggttgccgaagaggagatggctagctcgactagtgattctggggaagaatctgacagcagtagctctagcagcagcactagtgacagcagcagcagcagcagcactagtggcagcagcagcggcagcggcagcagcagcagcagcagcggcagcactagcagccgcagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactat

SEQ ID NO: 161432 - DNA, 2511 bp, Homo sapiens
  Payload ID: 11519
  Gene Symbol: NAP1L4
  Gene Name: nucleosome assembly protein 1-like 4
  Uniprot ID: Q99733
  ENST ID: ENST00000380542
  CDS Start-End: 142-1269
cttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaaggtgtaatttttgtctgttaatcattcatacgtttctagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 161433 - DNA, 594 bp, Homo sapiens
  Payload ID: 11519
  Gene Symbol: NAP1L4
  Gene Name: nucleosome assembly protein 1-like 4
  ENST ID: ENST00000399614
  CDS Start-End: 127-594
aaagcgagcgaagctagggtcgccgccactgccgcaggaggcgtgagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacac

SEQ ID NO: 161434 - DNA, 888 bp, Homo sapiens
  Payload ID: 11519
  Gene Symbol: NAP1L4
  Gene Name: nucleosome assembly protein 1-like 4
  ENST ID: ENST00000448187
  CDS Start-End: 53-888
gctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaacgcatgaggatgttgtatttcttactcccttttttagtttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaa

SEQ ID NO: 161435 - DNA, 860 bp, Homo sapiens
  Payload ID: 11519
  Gene Symbol: NAP1L4
  Gene Name: nucleosome assembly protein 1-like 4
  ENST ID: ENST00000430811
  CDS Start-End: 327-860
ggtcggggcaggcagcggcggccgcggcggggcctggggcttggggcctggagcccgggcctggggcgctggcgggaggcccctcccaactcccggcgcgcctcgcccggctgcccgcctcactgaaggtcaaggcgctttgttctgcgccgcgggcggcctcctgggcggcggccccttggaggaggcgaagacggcgagaggcggcggccgctcaaatctcccgctagcccagcccgccccgcgtgcgggggctgtggcggttacacggccgggcgcgccggagcgttcaggcttcccgtttttaaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccag

SEQ ID NO: 161436 - DNA, 352 bp, Homo sapiens
  Payload ID: 11519
  Gene Symbol: NAP1L4
  Gene Name: nucleosome assembly protein 1-like 4
  ENST ID: ENST00000455338
  CDS Start-End: 49-352
cctcagctgaatttttgtgggacctcctgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaacgcatgaggatgttgtatttcttactcccttttttagtttacctaaagcagtaaaaagaagaattaatgcattgaaacaacttcaggtgagatgtgctcacatagaagccaagttctatgaagaggtacatg

SEQ ID NO: 161437 - DNA, 850 bp, Homo sapiens
  Payload ID: 11519
  Gene Symbol: NAP1L4
  Gene Name: nucleosome assembly protein 1-like 4
  ENST ID: ENST00000492685
  CDS Start-End: 1-615
gaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaatccagatatgtagtccaagctgctgtccttgttgtggggggaatacgcttgaagaggagaagtctgaggaacagagcaggaaaagcaggtgtctgtgaagcagtttcagagtttgaagaaggtgaagaaggagaagaggaggaattagaaggtgacgaggagggagaagacgaggatgatgcggaaattaaccccaagaaggaacccagccagccggcggaatgcaagcagcagtaggaagcggaggc

SEQ ID NO: 161438 - DNA, 535 bp, Homo sapiens
  Payload ID: 11519
  Gene Symbol: NAP1L4
  Gene Name: nucleosome assembly protein 1-like 4
  ENST ID: ENST00000526842
  CDS Start-End: 150-535
aggcgtgaggtgcggagacacgggtgctgggccggctggagtgcagtggcttgatcttggctcacggcaacctctgcctcctgtattcaagcgattctcctgcctcagcctcccgagtagctgggattacaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaaga

SEQ ID NO: 161439 - DNA, 625 bp, Homo sapiens
  Payload ID: 11519
  Gene Symbol: NAP1L4
  Gene Name: nucleosome assembly protein 1-like 4
  ENST ID: ENST00000530064
  CDS Start-End: 226-625
aaagtgttttaggcttccagagtagaaatctgatattacttcgtttgattcttcgaccactatggtgataggaagtagctgatctctgcaggaaactgctgttacctggcctcagctgaatttttgtgggacctcctgagagacgaggtttccccatgttgcccaggctggtctgaaactcctgagcttcaggtgatctgtgataggggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattgg

SEQ ID NO: 161440 - DNA, 544 bp, Homo sapiens
  Payload ID: 11519
  Gene Symbol: NAP1L4
  Gene Name: nucleosome assembly protein 1-like 4
  ENST ID: ENST00000534372
  CDS Start-End: 309-544
gtgaggtgcggagacacgggtgctgggccgggaaaagtgttttaggcttccagagtagaaatctgatattacttcgtttgattcttcgaccactatggtgataggaagtagctgatctctgcaggaaactgctgttacctggcctcagctgaatttttgtgggacctcctgagggcttggcaccgcagaagtctctgaagagacagtctgctgctgtttggagagacgaggtttccccatgttgcccaggctggtctgaaactcctgagcttcaggtgatctgtgataggggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctca

SEQ ID NO: 161441 - DNA, 587 bp, Homo sapiens
  Payload ID: 11519
  Gene Symbol: NAP1L4
  Gene Name: nucleosome assembly protein 1-like 4
  ENST ID: ENST00000528968
  CDS Start-End: 167-587
gtgaggtgcggagacacgggtgctgggccggaagtagctgatctctgcaggaaactgctgttacctggcctcagctgaatttttgtgggacctcctgagggcttggcaccgcagaagtctctgaagagacagtctgctgctgtttggaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaag

SEQ ID NO: 161442 - DNA, 555 bp, Homo sapiens
  Payload ID: 11519
  Gene Symbol: NAP1L4
  Gene Name: nucleosome assembly protein 1-like 4
  ENST ID: ENST00000529361
  CDS Start-End: 48-555
gtgaggtgcggagacacgggtgctgggccggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaacgcatgaggatgttgtatttcttactcccttttttagtttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaag

SEQ ID NO: 161443 - DNA, 1941 bp, Homo sapiens
  Payload ID: 11519
  Gene Symbol: NAP1L4
  Gene Name: nucleosome assembly protein 1-like 4
  Uniprot ID: Q99733
  ENST ID: ENST00000526115
  CDS Start-End: 285-1445
cttgctcgcggagagaggagctaggagcctcggccaatgggagccggcgttgttggaggccacggcggcgcagccccaaagcgagcgaagctagggtcgccgccactgccgcaggaggcgtgagggaaaagtgttttaggcttccagagtagaaatctgatattacttcgtttgattcttcgaccactatggtgataggaagtagctgatctctgcaggaaactgctgttacctggcctcagctgaatttttgtgggacctcctgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcaga

SEQ ID NO: 161444 - DNA, 526 bp, Homo sapiens
  Payload ID: 11519
  Gene Symbol: NAP1L4
  Gene Name: nucleosome assembly protein 1-like 4
  ENST ID: ENST00000532325
  CDS Start-End: 65-526
aaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcag

SEQ ID NO: 161445 - DNA, 572 bp, Homo sapiens
  Payload ID: 11519
  Gene Symbol: NAP1L4
  Gene Name: nucleosome assembly protein 1-like 4
  ENST ID: ENST00000531291
  CDS Start-End: 252-572
cgtgaggtgcggagacacgggtgctgggccggtttacggggtgaaaatagacttttaaaaattctcttaccttagaaatatacaaatatgtagattaggttgttggaccttaaaggaagtagctgatctctgcaggaaactgctgttacctggcctcagctgaatttttgtgggacctcctgagggcttggcaccgcagaagtctctgaagagacagtctgctgctgtttggaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaaga

SEQ ID NO: 161446 - DNA, 2479 bp, Homo sapiens
  Payload ID: 11519
  Gene Symbol: NAP1L4
  Gene Name: nucleosome assembly protein 1-like 4
  Uniprot ID: Q99733
  ENST ID: ENST00000616696
  CDS Start-End: 142-1302
cttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttcatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtcagc

SEQ ID NO: 161447 - DNA, 2479 bp, Homo sapiens
  Payload ID: 11519
  Gene Symbol: NAP1L4
  Gene Name: nucleosome assembly protein 1-like 4
  Uniprot ID: Q99733
  ENST ID: ENST00000620138
  CDS Start-End: 142-1302
cttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtcagc

SEQ ID NO: 161448 - DNA, 2515 bp, Homo sapiens
  Payload ID: 11519
  Gene Symbol: NAP1L4
  Gene Name: nucleosome assembly protein 1-like 4
  Uniprot ID: Q99733
  ENST ID: ENST00000619695
  CDS Start-End: 142-1269
cttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaaggtgtaatttttgtctgttaatcattcatacgtttctagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttcatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtca

SEQ ID NO: 161449 - DNA, 625 bp, Homo sapiens
  Payload ID: 11519
  Gene Symbol: NAP1L4
  Gene Name: nucleosome assembly protein 1-like 4
  ENST ID: ENST00000633351
  CDS Start-End: 226-625
aaagtgttttaggcttccagagtagaaatctgatattacttcgtttgattcttcgaccactatggtgataggaagtagctgatctctgcaggaaactgctgttacctgacctcagctgaatttttgtgggacctcctgagagacgaggtttccccatgttgcccaggctggtctgaaactcctgagcttcaggtgatctgtgataggggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattgg

SEQ ID NO: 161450 - DNA, 594 bp, Homo sapiens; identical to SEQ ID NO: 161433
  Payload ID: 11519
  Gene Symbol: NAP1L4
  Gene Name: nucleosome assembly protein 1-like 4
  ENST ID: ENST00000634217
  CDS Start-End: 127-594

SEQ ID NO: 161451 - DNA, 1941 bp, Homo sapiens
  Payload ID: 11519
  Gene Symbol: NAP1L4
  Gene Name: nucleosome assembly protein 1-like 4
  Uniprot ID: Q99733
  ENST ID: ENST00000632791
  CDS Start-End: 285-1445
cttgctcgcggagagaggagctaggagcctcggccaatgggagccggcgttgttggaggccacggcggcgcagccccaaagcgagcgaagctagggtcgccgccactgccgcaggaggcgtgagggaaaagtgttttaggcttccagagtagaaatctgatattacttcgtttgattcttcgaccactatggtgataggaagtagctgatctctgcaggaaactgctgttacctgacctcagctgaatttttgtgggacctcctgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcaga

SEQ ID NO: 161452 - DNA, 850 bp, Homo sapiens; identical to SEQ ID NO: 161437
  Payload ID: 11519
  Gene Symbol: NAP1L4
  Gene Name: nucleosome assembly protein 1-like 4
  ENST ID: ENST00000634125
  CDS Start-End: 1-615

SEQ ID NO: 161453 - DNA, 535 bp, Homo sapiens; identical to SEQ ID NO: 161438
  Payload ID: 11519
  Gene Symbol: NAP1L4
  Gene Name: nucleosome assembly protein 1-like 4
  ENST ID: ENST00000632755
  CDS Start-End: 150-535

SEQ ID NO: 161454 - DNA, 555 bp, Homo sapiens; identical to SEQ ID NO: 161442
  Payload ID: 11519
  Gene Symbol: NAP1L4
  Gene Name: nucleosome assembly protein 1-like 4
  ENST ID: ENST00000632239
  CDS Start-End: 48-555

SEQ ID NO: 161455 - DNA, 860 bp, Homo sapiens
  Payload ID: 11519
  Gene Symbol: NAP1L4
  Gene Name: nucleosome assembly protein 1-like 4
  ENST ID: ENST00000631563
  CDS Start-End: 327-860
ggtcggggcaggcagcggcggccgcggcggggcctggggcttgggccctggagcccgggcctggggcgctggcgggaggcccctcccaactcccggcgcgcctcgcccggctgcccgcctcactgaaggtcaaggcgctttgttctgcgccgcgggcggcctcctgggcggcggccccttggaggaggcgaagacggcgagaggcggcggccgctcaaatctcccgctagcccagcccgccccgcgtgcgggggctgtggcggttacacggccgggcgcgccggagcgttcaggcttcccgtttttaaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccag

SEQ ID NO: 161456 - DNA, 888 bp, Homo sapiens; identical to SEQ ID NO: 161434
  Payload ID: 11519
  Gene Symbol: NAP1L4
  Gene Name: nucleosome assembly protein 1-like 4
  ENST ID: ENST00000632355
  CDS Start-End: 53-888

SEQ ID NO: 161457 - DNA, 352 bp, Homo sapiens; identical to SEQ ID NO: 161436
  Payload ID: 11519
  Gene Symbol: NAP1L4
  Gene Name: nucleosome assembly protein 1-like 4
  ENST ID: ENST00000631478
  CDS Start-End: 49-352

SEQ ID NO: 161458 - DNA, 572 bp, Homo sapiens
  Payload ID: 11519
  Gene Symbol: NAP1L4
  Gene Name: nucleosome assembly protein 1-like 4
  ENST ID: ENST00000633461
  CDS Start-End: 252-572
cgtgaggtgcggagacacgggtgctgggccggtttacggggtgaaaatagacttttaaaaattctcttaccttagaaatatacaaatatgtagattaggttgttggaccttaaaggaagtagctgatctctgcaggaaactgctgttacctgacctcagctgaatttttgtgggacctcctgagggcttggcaccgcagaagtctctgaagagacagtctgctgctgtttggaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaaga

SEQ ID NO: 161459 - DNA, 587 bp, Homo sapiens
  Payload ID: 11519
  Gene Symbol: NAP1L4
  Gene Name: nucleosome assembly protein 1-like 4
  ENST ID: ENST00000632038
  CDS Start-End: 167-587
gtgaggtgcggagacacgggtgctgggccggaagtagctgatctctgcaggaaactgctgttacctgacctcagctgaatttttgtgggacctcctgagggcttggcaccgcagaagtctctgaagagacagtctgctgctgtttggaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaag

SEQ ID NO: 161460 - DNA, 544 bp, Homo sapiens
  Payload ID: 11519
  Gene Symbol: NAP1L4
  Gene Name: nucleosome assembly protein 1-like 4
  ENST ID: ENST00000631916
  CDS Start-End: 309-544
gtgaggtgcggagacacgggtgctgggccgggaaaagtgttttaggcttccagagtagaaatctgatattacttcgtttgattcttcgaccactatggtgataggaagtagctgatctctgcaggaaactgctgttacctgacctcagctgaatttttgtgggacctcctgagggcttggcaccgcagaagtctctgaagagacagtctgctgctgtttggagagacgaggtttccccatgttgcccaggctggtctgaaactcctgagcttcaggtgatctgtgataggggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctca

SEQ ID NO: 161461 - DNA, 2321 bp, Homo sapiens
  Payload ID: 11520
  Gene Symbol: NAP1L5
  Gene Name: nucleosome assembly protein 1-like 5
  Uniprot ID: Q96NT1
  ENST ID: ENST00000323061
  CDS Start-End: 482-1030
tctaagaggtgatcaaacgccagctatggagagagatgcagaggaaagcgaagacatatgcactggcatttgtagaagggcctggatgggggtgaggagcacacggaaaatggtctgaggccatctatgcagttcctgaagaagcacctcgggcagctactgacactcccagcccagctctacaggggtgggtacatgggtgggctgggaacagggtgtctgtccaacaggcgggtgttgagggcccagaagatgtcagggtagcaacaggaggaatctggtgcagtatgagcacacggccgtcagctgatagtgggaagccagtcaagtgccgcgaaagcaggaggcggggccgcggccaacgtcattcccgcggccgcacgtcaccgccacttgccgcatccgcaagatctctctggaccagctcgggtgcagggcctctgcgggagccctcctagacctctgcggcttctcctctaacatggccgactcggaaaaccaggggcctgcggagcctagccaggcggcggcagcggcggaggcagcggcagaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtggtgttaataaaacagtattttcaaaaaata

SEQ ID NO: 161462 - DNA, 2044 bp, Homo sapiens
  Payload ID: 11521
  Gene Symbol: NAP1L6
  Gene Name: nucleosome assembly protein 1-like 6
  Uniprot ID: A6NFF2
  ENST ID: ENST00000373518
  CDS Start-End: 199-522
ctccttttgccatggcagctagtggggaaagccctttagcccgctactcttgccttccacggcttccgccaccccaggccagcttccacagcagctgtagctgcttcgttccgcctccgtcttagcacccccaggtgccggcggcccgggccaagccatcgcctacagttcggtgagtgtttccctgccaaaaagctaatgatggaagggctcggagaacacagcacagccggtgaaatgggcccattactcggcgctgtggcagccacagcctctccgcagtctttgatggagtactcctcagacgcagattttattgagagcctgcctctggtggttaagtaccgagtgtacactctcaaaaagcttcaggccaaatgtgccgtgctagaggccaagtacctgagggaatttcattctgtcgagaggaagtttgccaccatctatggacccttattggaaaagagacggcagatcaccaatgcactgtatgagcccacgaaagaggagtgtgagaggtgaagtccaaggttgaggactatgagtataatgaggtggccggtgattctaatgctcagatgtatggtgcagaggagaatccggagtatgaggacttggtggaggatcgtgaggaggatttcgaggatgtcggggaggtgtttggggagtatgaaggaatcgagggacataatgtggacggagaaaaagataatcctacagggatccccgatttctggctcacggctttatagaatgcccaggaggttgccccgctgattaagaaatatgacgaggccaggcgcagtggctcacgcctgtaatcccagcactttgggaggccgaggcaggtggatcacaagttcaggaaatcgagaccatcctggctaacacagtgaaaccccgtctctactaaaaatacaaaaaaaaaaaaaaaaaaaattagccgggggtggtggcacacacctatagtcccagctgcccaggaggctgaggcaggagaatcgcttgaacccaagaggcagaggttgcagtgaactgagatcgcaccactgcactccagcctgggcgacagagcgatattccgaaaaaacgaaacaacaacaacaaaaatatgacgagcccattctgaagctcttgcaagacgtgaaagtcaagttttcaaaatcaaactagccactcacttttacgctggaatttcactctgaacccaacgactacttcacaaatgaggtgctgaccgaaagaaacatacatcctcaagtctaagctcgattagtctgacccccaccccttcaggggatctgcggtagagcgttgctttggcagcatgatagaatggaagaagggaaagaacgtcactgtgcaaacggtcctgaagagagacacagtttttgggggctgatgtgtaccgccactcaggaatttccccaagagtcccttcttcaatgctctccagtggggcctagatgctaatgaggatgaggaagacttcttcatcgctcacaccttgcacacttttgtcatcccaagagctgtgttacactttacaggagaagcccttgaggcagagcaagatacgatgatcagggaatgtaataatccggtttatgacagaatgactcaggagaattgggtgactgcagtttatggtgctaaaggccaaaaccgaaactcccaggcagaagtcaatgattgttgaagcagaatggttggagtatgtgggcctccaggttaacaactggcttttacaataaccaaaacttaatcattcgttacttacagtcttaacgtgtctcttcttggtagtctcagtttaaaattatgtccaaatatatttaacaatgcatttcatctagcactccagtggtgtaaactttgtcaacaattttattaggcagtgaattctcaacgtatgtgaagaccttactattgtgaatccatggcttttgtcaggttgctactagtctgcatctatggaaaattaccagaacttgtaactaagatctatgtttgggtttgtaaaataaagtgagatagcatcctt

SEQ ID NO: 161463 - DNA, 1228 bp, Homo sapiens
  Payload ID: 11522
  Gene Symbol: NUBP1
  Gene Name: nucleotide binding protein 1
  Uniprot ID: P53384
  ENST ID: ENST00000283027
  CDS Start-End: 20-982
aggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctc

SEQ ID NO: 161464 - DNA, 1185 bp, Homo sapiens
  Payload ID: 11522
  Gene Symbol: NUBP1
  Gene Name: nucleotide binding protein 1
  Uniprot ID: P53384
  ENST ID: ENST00000433392
  CDS Start-End: 10-939
ggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcagtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctc

SEQ ID NO: 161465 - DNA, 674 bp, Homo sapiens
  Payload ID: 11522
  Gene Symbol: NUBP1
  Gene Name: nucleotide binding protein 1
  ENST ID: ENST00000571175
  CDS Start-End: 1-428
gcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctc

SEQ ID NO: 161466 - DNA, 517 bp, Homo sapiens
  Payload ID: 11522
  Gene Symbol: NUBP1
  Gene Name: nucleotide binding protein 1
  ENST ID: ENST00000574691
  CDS Start-End: 1-191
tcatcaccactccccaggaggtgtcactccaggatgtccggaaagaaatcaacttctgccgcaaggtgaagctgcccatcatcggggtggtggagaacatgagtggcttcatctgtcctaagtgcaaggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctc

SEQ ID NO: 161467 - DNA, 582 bp, Homo sapiens
  Payload ID: 11522
  Gene Symbol: NUBP1
  Gene Name: nucleotide binding protein 1
  ENST ID: ENST00000574334
  CDS Start-End: 79-582
gagaatcagattgtgcccacaaggcggaaatgtacgacagcgggttccggtgaccacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacac

SEQ ID NO: 161468 - DNA, 1413 bp, Homo sapiens
  Payload ID: 11523
  Gene Symbol: NUBP2
  Gene Name: nucleotide binding protein 2
  Uniprot ID: Q9Y5Y2
  ENST ID: ENST00000262302
  CDS Start-End: 121-936
aagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccctgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagccggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcgggacttctgcagtcctcaggtgaccccgggcctccagcaccctgggtcgctgtcatctgtgtttagctcggggagtgccccctaagggggcgaactgacctcaggcatgttttgtaactgtagaggcgcctgccattaaacgtgtccgctgctgtggcgacagatctga

SEQ ID NO: 161469 - DNA, 470 bp, Homo sapiens
  Payload ID: 11523
  Gene Symbol: NUBP2
  Gene Name: nucleotide binding protein 2
  ENST ID: ENST00000563136
  CDS Start-End: 54-470
gacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggctgtgccgctccttgcaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacac

SEQ ID NO: 161470 - DNA, 815 bp, Homo sapiens
  Payload ID: 11523
  Gene Symbol: NUBP2
  Gene Name: nucleotide binding protein 2
  ENST ID: ENST00000565134
  CDS Start-End: 15-770
ctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggtgagtcccgggggttgcagagggggcgaggcagcacctggccggtgggggctttgggcagtgctgggctcaccaccgtctcctaggagtgcaccagcgtcttctccaggggcggcggagaggagctggcccagctcgccggggtgcccttcttaggctccgtgcccctggaccctgcgctcatgaggaccctggaggagg

SEQ ID NO: 161471 - DNA, 839 bp, Homo sapiens
  Payload ID: 11523
  Gene Symbol: NUBP2
  Gene Name: nucleotide binding protein 2
  ENST ID: ENST00000568287
  CDS Start-End: 27-839
agccgcgagctcctggaggcggcgggatggaggcggcggccggagtgtggggctggggctgccttttccgcgtcccctggaggagacctcaggcagcctctgtaggtctgaggacccgcctgcatgccaggttctccgggaggctttggacttgggagcctttgaacgtgcccttgagaggcggatcagaagggggcaggttttacgcatcatgtgttgagcccctcacatgcaccctccaaggacctgtcggggatggagcagcttgctggagacaaggggcatggcctcagcggtggcgccgggagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgg

SEQ ID NO: 161472 - DNA, 903 bp, Homo sapiens
  Payload ID: 11523
  Gene Symbol: NUBP2
  Gene Name: nucleotide binding protein 2
  ENST ID: ENST00000564227
  CDS Start-End: 1-175
ggaggcggcggccggtgagtggcgggccagggtgcggagccgctccagggcctcgcttggggccccgccgcgtcccttcccggggcggcctcgctgcgtcgcgcgcctccggtgcgaccatcaccggccggcgtggctgggccgggccagaggccgcggcgcgggcattttctaaacagggtcgtttcccgcgtgctcctgcttcgatgtggaagctccgtgatctcggagggcctgagtcgtggagttgggggagcttttaaagttaactttgttgagcaccgcgttgtaggcgggcgcggtggcgcctgtgggccccgctatcctggaggtcgcggttgcaactgcaccgcagcccgggcaagagcgagaccctgtctctaaataaatcacacgcgcgcagtcatgaaagtaagacggacgccagaatctcacatgcttttaagttctttgtggaagtggcgctctcagtgttcagaaaagtagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccata

SEQ ID NO: 161473 - DNA, 1049 bp, Homo sapiens
  Payload ID: 11523
  Gene Symbol: NUBP2
  Gene Name: nucleotide binding protein 2
  ENST ID: ENST00000565987
  CDS Start-End: 402-1037
actgcagccgcgagctcctggaggcggcgggatggaggcggcggccgtagagacggggtttcaccgtgttagccaggatggtctcgatctcctgacctcgtgatccgcccgtctcagcctcccaaagtgctgggattacaggcgtgagccacggcgcctggcccagtgctggagtcttattccagaggagaagcctggaaaagcctgtccttattatcaggacggatttactacaaaagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccctgggagccccgccttcgctgcactcacctccatagcccagaagattctggacgcgacgcccgcgtgcctcccctgactaaggccacct

SEQ ID NO: 161474 - DNA, 811 bp, Homo sapiens
  Payload ID: 11523
  Gene Symbol: NUBP2
  Gene Name: nucleotide binding protein 2
  ENST ID: ENST00000562263
  CDS Start-End: 379-811
ccggctaattttttgtatttttagtagagacggggtttcaccgtgttagccaggatggtctcgatctcctgacctcgtgatccgcccgtctcagcctcccaaagtgctgggattacaggcgtgagccacggcgcctggcccagtgctggagtcttattccagaggagaagcctggaaaagcctgtccttattatcaggacggatttactacaaaagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcg

SEQ ID NO: 161475 - DNA, 582 bp, Homo sapiens
  Payload ID: 11523
  Gene Symbol: NUBP2
  Gene Name: nucleotide binding protein 2
  ENST ID: ENST00000569898
  CDS Start-End: 23-163
gcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggggcggcggagaggagctggcccagctcgccggggtgcccttcttaggctccgtgcccctggaccctgcgctcatgaggaccctggaggagggccacgacttcatccaggagttccctgggagccccgccttcgctgcactcacctccatagcccagaa

SEQ ID NO: 161476 - DNA, 1173 bp, Homo sapiens
  Payload ID: 11523
  Gene Symbol: NUBP2
  Gene Name: nucleotide binding protein 2
  ENST ID: ENST00000568834
  CDS Start-End: 90-230
attggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccctgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagccggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcgggacttctgcagtcctcaggtgaccccgggcctccagcaccctgggtcgctgtcatctgtgtttagctcggggagtgccccctaagggggcgaactgacctcaggcatgttttgtaactgtagaggcgcctgccattaaacgtgtccgctgctgtggcg

SEQ ID NO: 161477 - DNA, 913 bp, Homo sapiens
  Payload ID: 11523
  Gene Symbol: NUBP2
  Gene Name: nucleotide binding protein 2
  ENST ID: ENST00000568706
  CDS Start-End: 266-658
tccagaggagaagcctggaaaagcctgtccttattatcaggacggatttactacaaaagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccctgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagccggagagcttctccccgaccagcccagccccaggatgtgtcgcaccagcagctctgcctggttggcctgcagtgccgtggtctgcgtgctctgcagctgtgagacgggggcggcctgggctctcttcccatccat

SEQ ID NO: 161478 - DNA, 3049 bp, Homo sapiens
  Payload ID: 11524
  Gene Symbol: NUBPL
  Gene Name: nucleotide binding protein-like
  Uniprot ID: Q8TB37
  ENST ID: ENST00000281081
  CDS Start-End: 46-1005
acccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaa

SEQ ID NO: 161479 - DNA, 560 bp, Homo sapiens
  Payload ID: 11524
  Gene Symbol: NUBPL
  Gene Name: nucleotide binding protein-like
  ENST ID: ENST00000550005
  CDS Start-End: 398-560
agaaatgcagaagcagatggtactgctgaaccaaatgtgtgaaaggctagtaactcatagatgcatataatttttagagttggaagagaccaaggagttaaattcatctaactcccattctataagtatttcagatgactgcagttgtgtcctcatcatcaatctctaaatgaagttacttgaagcaattcttgaaaccataataataatgtctccagaattggtggattcttggtctcactgacttcaagaatgaagccacggaccctcgcgaaggactttggacaacaatttctttgactgaaactggggtcagagttgcagactccctggaacatgaaaagtcaataatctagttcccaaaaggcagacaagaaactattcccaagatgaacaaatgatgagaatagaggtaaaggtgaaaatgatgttgtctggcgccgggagtgagaccctaaaacaaagaagaacacaaatcatgtcccgaggacttccaaagcagaaaccgatagaaggtgttaaacaagttatagttgtggcttctggaaagggtggagtcg

SEQ ID NO: 161480 - DNA, 567 bp, Homo sapiens
  Payload ID: 11524
  Gene Symbol: NUBPL
  Gene Name: nucleotide binding protein-like
  ENST ID: ENST00000551314
  CDS Start-End: 168-567
ttcttgccaaagactcgcctcagttcctgagacccccagtgtgctggacgtgcctacttttcaggcaggcccaggctgaggcgtggcgggacttgaaacacagttagaacgtagatgtgttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccac

SEQ ID NO: 161481 - DNA, 541 bp, Homo sapiens
  Payload ID: 11524
  Gene Symbol: NUBPL
  Gene Name: nucleotide binding protein-like
  ENST ID: ENST00000552489
  CDS Start-End: 1-312
atggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtagagacggggtttcaccgtgttaaccaggatggtctccatctcctgatctcgtgatccgcccgcctagccctcccaaagtgctgggattacagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaa

SEQ ID NO: 161482 - DNA, 557 bp, Homo sapiens
  Payload ID: 11524
  Gene Symbol: NUBPL
  Gene Name: nucleotide binding protein-like
  ENST ID: ENST00000550649
  CDS Start-End: 56-557
actccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcggtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaag

SEQ ID NO: 161483 - DNA, 556 bp, Homo sapiens
  Payload ID: 11524
  Gene Symbol: NUBPL
  Gene Name: nucleotide binding protein-like
  ENST ID: ENST00000549838
  CDS Start-End: 1-393
gtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagtatatctcagagatgttgcaggtcttgttccagaccaccacaataaagcaagtgtctcaataaagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtca

SEQ ID NO: 161484 - DNA, 2001 bp, Homo sapiens
  Payload ID: 11524
  Gene Symbol: NUBPL
  Gene Name: nucleotide binding protein-like
  Uniprot ID: Q8TB37
  ENST ID: ENST00000547839
  CDS Start-End: 43-564
cgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactcca

SEQ ID NO: 161485 - DNA, 4499 bp, Homo sapiens
  Payload ID: 11525
  Gene Symbol: NOD1
  Gene Name: nucleotide-binding oligomerization domain containing 1
  Uniprot ID: Q9Y239
  ENST ID: ENST00000222823
  CDS Start-End: 527-3388
cccgttccgggcccgcgaggcagccgccccggtcctgcccctccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 161486 - DNA, 757 bp, Homo sapiens
  Payload ID: 11525
  Gene Symbol: NOD1
  Gene Name: nucleotide-binding oligomerization domain containing 1
  ENST ID: ENST00000419799
  CDS Start-End: 579-757
ccctccctcgcgctactgcgggagcagcgtcctcccgggccacggcgcttcccggccccggcgtccccggaccatggcgctctccgggctcttctctagctctcagcggctgcgaagtctgtaaacctggtggccaacatctcagttataagaaatgcacatctccgctcaaggtcccctgggacagtgcaaggaaagaaagaagcctgcggtgaaagtgacactgagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgc

SEQ ID NO: 161487 - DNA, 794 bp, Homo sapiens
  Payload ID: 11525
  Gene Symbol: NOD1
  Gene Name: nucleotide-binding oligomerization domain containing 1
  ENST ID: ENST00000411552
  CDS Start-End: 616-794
actgcgggagcagcgtcctcccgggccacggcgcttcccggccccggcgtccccggaccatggcgctctccgggctcttctctagctctcagcggctgcgaagtctgtaaacctggtggccaaggacagtcagttgcatgtcacacaaggggcctcctttgatttatccaaaaggtctgacctggtttctggaaaaactctttagcgcatcaaatactcgttgagggcaagtgttgtttctaaacttgactcttgtggtgagaggtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgc

SEQ ID NO: 161488 - DNA, 637 bp, Homo sapiens
  Payload ID: 11525
  Gene Symbol: NOD1
  Gene Name: nucleotide-binding oligomerization domain containing 1
  ENST ID: ENST00000413433
  CDS Start-End: 459-637
cggctgcgaagtctgtaaacctggtggccaaaagccaagtcatccagaagccagcttctgcagctccaaagagggccttagcagttacaaagaaacacaagataacggtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgc

SEQ ID NO: 161489 - DNA, 578 bp, Homo sapiens
  Payload ID: 11525
  Gene Symbol: NOD1
  Gene Name: nucleotide-binding oligomerization domain containing 1
  ENST ID: ENST00000419601
  CDS Start-End: 442-578
agttcccgttccgggcccgcgaggcagccgccccggtcctgcccctccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcagggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaa

SEQ ID NO: 161490 - DNA, 4610 bp, Homo sapiens
  Payload ID: 11525
  Gene Symbol: NOD1
  Gene Name: nucleotide-binding oligomerization domain containing 1
  ENST ID: ENST00000434755
  CDS Start-End: 485-2824
ccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggactttggaaatcagtagacaccatatgcttcaaaaaacaggggctattaaaatgacatcaggagccagaaagtctcatggctgtgctttctcttgaagtttatacaacaaccagatcaccgatgtcggagccagactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgaacttgtttggaacttgtcataaaatcgatcagtttggtgaattgcaaccaacaatatttaaaaagaaaacagaacagaacaaaatatcaggatgcaatgtgcatgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactc

SEQ ID NO: 161491 - DNA, 4486 bp, Homo sapiens
  Payload ID: 11526
  Gene Symbol: NOD2
  Gene Name: nucleotide-binding oligomerization domain containing 2
  Uniprot ID: Q9HC29
  ENST ID: ENST00000300589
  CDS Start-End: 106-3228
gtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagctctattcaacaacaaattgactgacggctgtgcacactccatggctaagctccttgcatgcaggcagaacttcttggcattgaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaaca

SEQ ID NO: 161492 - DNA, 624 bp, Homo sapiens
  Payload ID: 11526
  Gene Symbol: NOD2
  Gene Name: nucleotide-binding oligomerization domain containing 2
  ENST ID: ENST00000531674
  CDS Start-End: 187-624
ggagtgggccttggagtcggcgcgcaggcggctcgcgcaaggaagtgatcctttctctacatgggcctcaccttggggaggacaatggtgtctttgaagttgtagtaactgaagtagagatcaaaaggcaatgcagatagactgacagatttcgcctgaagaggggaagcccgaccaggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccg

SEQ ID NO: 161493 - DNA, 1707 bp, Homo sapiens
  Payload ID: 11526
  Gene Symbol: NOD2
  Gene Name: nucleotide-binding oligomerization domain containing 2
  ENST ID: ENST00000527070
  CDS Start-End: 105-212
tagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggtaagaggagcaggcattgtcccgtcccagcttgatcctcagccttctttcatccttggccgcgacatgctcccaggcctggggtcagatggggagtgctgactctgtttctgggctgttttctggggagaatgggtcggcgggtttttttccccaggacctgggcagggtcaatggtgggggccgctgtcgcatccttggctggtgtttccacagctgagaaccactccagggccaagcccagagcttattctacccttttttgtcctctcttcccctgtcctcggccaccccaccctcttggctcctctgcttagatgtgggcacaaggaggagaactccttggcctgagagaactaccttagatcctggcttccagtggcctctgcaggggggtacaccctctctcccaagcagccagacacacaagtaacctcattgcctcagtttccccatctgaccagcacagggccccctgtgccccagcagcgttctgagagattggagctttctccttttgcttaccttggctaccgtatgaggacggatacagagtgttccccccacccccagcccaggggatatttgattcatgaacattccctcagtgtctttgtgggggacaatgctgtgccaggctcagggatgccaggacgagtaagacccaggctcccacgtggcccaggcagggagagagacacataaacaaccatcaggaaagaggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggaca

SEQ ID NO: 161494 - DNA, 506 bp, Homo sapiens
  Payload ID: 11526
  Gene Symbol: NOD2
  Gene Name: nucleotide-binding oligomerization domain containing 2
  ENST ID: ENST00000534057
  CDS Start-End: 1-506
cctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagcgctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctag

SEQ ID NO: 161495 - DNA, 450 bp, Homo sapiens
  Payload ID: 11526
  Gene Symbol: NOD2
  Gene Name: nucleotide-binding oligomerization domain containing 2
  ENST ID: ENST00000529633
  CDS Start-End: 1-181
cctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtagtgagtgttactgggcattgctgttcaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctag

SEQ ID NO: 161496 - DNA, 602 bp, Homo sapiens
  Payload ID: 11526
  Gene Symbol: NOD2
  Gene Name: nucleotide-binding oligomerization domain containing 2
  ENST ID: ENST00000534067
  CDS Start-End: 1-181
cctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtagtgagtgttactgggcattgctgttcaggtatgggggagcaccatcaaggctaagtgtgggagcaccgagctgggctctagaagtctgggcccagcttcgcctctgccaccctgctttgcaacactgcccagatcccttcccttctgggccttaatttcaatatgtgatgatgacagccacactttattgactggcctatgtgctgggtctggtgctatgctttccggaatgacctcatctaatctctacaaccaccctggcggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctag

SEQ ID NO: 161497 - DNA, 338 bp, Homo sapiens
  Payload ID: 11526
  Gene Symbol: NOD2
  Gene Name: nucleotide-binding oligomerization domain containing 2
  ENST ID: ENST00000527052
  CDS Start-End: 1-181
cctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtaattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctag

SEQ ID NO: 161498 - DNA, 366 bp, Homo sapiens
  Payload ID: 11526
  Gene Symbol: NOD2
  Gene Name: nucleotide-binding oligomerization domain containing 2
  ENST ID: ENST00000524712
  CDS Start-End: 1-181
cctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtagtgagtgttactgggcattgctgttcagattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctag

SEQ ID NO: 161499 - DNA, 4445 bp, Homo sapiens
  Payload ID: 11527
  Gene Symbol: NACC1
  Gene Name: nucleus accumbens associated 1, BEN and BTB (POZ) domain containing
  Uniprot ID: Q96RE7
  ENST ID: ENST00000292431
  CDS Start-End: 127-1710
aggccgcggaggcggaggccgaggccccggcgcagcggggcgcgccccgggcccaggcccggccccagccgccgctgcggagcccgccgggaccccccggagcgcggccacggcgcagccgctgccatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggaggaggatggtggcgaggagggcatggatgagcagtaccggcagatctgcaacatgtacaccatgtacagcatgatgaacgtcggccagacagccgagaaggtggaggccctcccggagcaggtagcccccgagtcccgaaatcgcatccgggttcggcaagacctggcgtctctcccggctgaacttatcaaccagattgggaaccgctgccaccccaagctctacgacgagggcgacccctctgagaagctggagctggtgacaggcaccaacgtgtacatcacaagggcgcagctgatgaactgccacgtcagcgcaggcacgcggcacaaggtcctactgcggcggctcctggcctccttctttgaccggaacacgctggccaacagctgcggcaccggcatccgctcttctaccaacgatccccgtcggaagcccctggacagccgcgtgctccacgctgtcaagtactactgccagaacttcgcccccaacttcaaggagagcgagatgaatgccatcgcggccgacatgtgcaccaacgcccgccgcgtcgtgcgcaagagctggatgcccaaggtcaaggtgctcaaggctgaggatgacgcctacaccaccttcatcagtgaaacgggcaagatcgagccggacatgatgggtgtggagcatggcttcgagaccgccagccacgagggcgaggcgggtccctcggctgaagccctgcagtaacccgcccagcctcccgcggggccacacacttcccctcccaacacacacacacacctgccatcttggtcatgagctactgtctgtccctccccaggacccgcggtgggtgctgcatgttcccggccctctgcccctcctgtcctaccccctttccccaccgagagctgggccgggagaggaccgcagggcaggtggcgtgaggtccgtgttgccttctttaacacacactcgtgcagtgggggagttctggctccccaacctaacccctagccgtcatctccacactcaccaggcccaccaggggagggggctggcctgggggtcttgggaaggcccctccccaggccctaggccacctcgcggaagccttcagcctccgcccctcactgcagccccttgggacttgaggggggccccaggggttctcaggacccctcccaccacctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccacacccaccccaccccacagcagggctcctggcccccacccccctgtacataatttttaaaacctttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgtgtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgcctcctggcctgccaccccaccccagcgtttaccccaaagcacaatgccctggtcacttggcaagcggctgggcctgacggaggccgaggggcagaccggggctccagccagacccctgaaaggaaggtgctcccccacttccaggccttagttggggtgggggggccagctcctgggcctggggtcttctcacccccacccccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgt

SEQ ID NO: 161500 - DNA, 615 bp, Homo sapiens
  Payload ID: 11527
  Gene Symbol: NACC1
  Gene Name: nucleus accumbens associated 1, BEN and BTB (POZ) domain containing
  ENST ID: ENST00000585663
  CDS Start-End: 1-285
gtgtacatcacaagggcgcagctgatgaactgccacaacttcgcccccaacttcaaggagagcgagatgaatgccatcgcggccgacatgtgcaccaacgcccgccgcgtcgtgcgcaagagctggatgcccaaggtcaaggtgctcaaggctgaggatgacgcctacaccaccttcatcagtgaaacgggcaagatcgagccggacatgatgggtgtggagcatggcttcgagaccgccagccacgagggcgaggcgggtccctcggctgaagccctgcagtaacccgcccagcctcccgcggggccacacacttcccctcccaacacacacacacacctgccatcttggtcatgagctactgtctgtccctccccaggacccgcggtgggtgctgcatgttcccggccctctgcccctcctgtcctaccccctttccccaccgagagctgggccgggagaggaccgcagggcaggtggcgtgaggtccgtgttgccttctttaacacacactcgtgcagtgggggagttctggctccccaacctaacccctagccgtcatctccacactcaccaggcccaccaggggagggggctggcctgggggtcttggga

SEQ ID NO: 161501 - DNA, 534 bp, Homo sapiens
  Payload ID: 11527
  Gene Symbol: NACC1
  Gene Name: nucleus accumbens associated 1, BEN and BTB (POZ) domain containing
  ENST ID: ENST00000586171
  CDS Start-End: 38-534
cccaggggcatagagaggagacggagccgccgctgccatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggt

SEQ ID NO: 161502 - DNA, 4217 bp, Homo sapiens
  Payload ID: 11528
  Gene Symbol: NUDCD1
  Gene Name: NudC domain containing 1
  Uniprot ID: Q96RS6
  ENST ID: ENST00000239690
  CDS Start-End: 376-2127
cggacttagaccctcagtagctcgggcacctaagcacacagaaagctagaacacgcatttccggggcggggtctcgccaccctgcctataatgtgagaatttaaccagcgcgggccgcctcctggttgctagggcctctgggtaacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttaacatttgttcaggctggtcaagatcttgaagaaaatatggatgaagacatatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgtactctgttcgttgattagttgctacaggctgtacctataagatgtacaggataatagttaaatgttgagtattgtacatatgtatttaagtggattgaataactgagtctacatggaggaggaaatgctagagaacagcaggtctaatattttttaagtttactgagagacctttattattattttcaaattaagtatagctttatgtaacttttagccagttgctctgccacagacatagacaaagagagataagatttcacattatccatcactgcataacaaaccacaccaaaactcagtggtttaaaacaaggacttttattatttttcacgattcagtgagttggctgtctctgctgtacagggcctctcagcctccagtagactagacgaatcttctttccatagtagagaaaacatcttaagagagcaagctccaatatgcaagagcttatcgatcctgtacatctatcatatttactaatgttccattggacaaagcaaatcacatggccaagtctagagtcagaatgaggggactacacaagctgacagcggatggtatgactcattgggggccattgatggaacaatcttaccacacaaggacaaattataatttatccttgtggctctctttatttttctaacaacttcaacaaaataatcctgtttatatgttatagtttcttgccacaaattttgttttttcaaacttacctttccaggtttgttttagtatgtatgtacctggaaatttttattactttttataccatttcaagatatgtatcttatataaacctcaagttggattttatattttaataaggaagttaagaccttcatttaagaggcagaagattaagataagaaatataagatagaaaagctttgttcctaacatatcttttgcctgtctgggcaagtatttgactcaactaaattttaatgaacgaatgaatgacagagaggaggaaaaaagatgaggattgcatacatgttctaaaccctttgtcagattgcagtttcctagagagtattgaggtgctaggtagaaagttaggaaaggtcctgaggactggtattgacaattggagtcctaatagtactctattcgtattaggaaagagagactagataccaaacatcacgagatcatagagatggaaaactgtatagtaaccaaaaaccaaaacagtgatatttccagaactttttagtattgttgtaaaacttcatgaaacaaaagaccatttaaatagtgaattattaaaaatctttatgatgggaaagtagatctaaattttctctaaaattttccccaaagataatatcctcttagggaacataagaaaaatgtataataaaaatgtggtgcttaattaaccatgactatgtatatattgccaattttagtaatcaatattctttgtgcatgtgatttttttgcatgattaatgttgaattgaaagctctcaggataattaatcctaaatattgtcgcatgttgacctacgttaaaagatgaataggtctagagccgtgatttcaagctattttcctgaaatgcttcagggattccataaacatttaaacaatgttctaaggtacatatacttagaacattgagatatatactacaagtgctaagaatatagtaccttgtatttttgttgatttttatcatgttttaaataggaatttataaaatatttatgatagtaataaagtagtattttatgtgttttgca

SEQ ID NO: 161503 - DNA, 2098 bp, Homo sapiens
  Payload ID: 11528
  Gene Symbol: NUDCD1
  Gene Name: NudC domain containing 1
  Uniprot ID: Q96RS6
  ENST ID: ENST00000427660
  CDS Start-End: 100-1764
agtacttcatagactttatcatacttcgtagcatccagtatgttttctttgctaagattattgattttgtattgaagggtcccatgtccatcgttttcaatgctttatctccagggttggagcatgcctgctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttaacatttgttcaggctggtcaagatcttgaagaaaatatggatgaagacatatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgta

SEQ ID NO: 161504 - DNA, 2286 bp, Homo sapiens
  Payload ID: 11528
  Gene Symbol: NUDCD1
  Gene Name: NudC domain containing 1
  ENST ID: ENST00000519607
  CDS Start-End: 109-435
gttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctgatactcaagtatcttaatcattctattggatattgtacccatttatctgattgataattagacttctagcaacctccgtcatgtataaccaggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttaacatttgttcaggctggtcaagatcttgaagaaaatatggatgaagacatatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgta

SEQ ID NO: 161505 - DNA, 1172 bp, Homo sapiens
  Payload ID: 11528
  Gene Symbol: NUDCD1
  Gene Name: NudC domain containing 1
  ENST ID: ENST00000521439
  CDS Start-End: 58-297
ttttctttgctaagattattgattttgtattgaagggtcccatgtccatcgttttcaatgctttatctccagggttggagcatgcctgctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctgatactcaagtatcttaatcattctattggatattgtacccatttatctgattgataattagacttctagcaacctccgtcatgtataaccaggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttaacatttgttcaggctggtcaagatcttgaagaaaatatggatgaagacatatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttata

SEQ ID NO: 161506 - DNA, 8005 bp, Homo sapiens
  Payload ID: 11529
  Gene Symbol: NUDCD2
  Gene Name: NudC domain containing 2
  Uniprot ID: Q8WVJ2
  ENST ID: ENST00000302764
  CDS Start-End: 91-564
agcggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgtattttaagtaaattaagagttaatgtaaatttcttaattagaatattattacttgagggattactttatgtcaagaagtttaaaaatagttaaaaccctaacaatagaagtggattaacacaaaagagaagtgtgatcatggtaattaggtgagtcctttgtggcagaaagcaaagtaaggtcactaattgtatatcagtggcatcattttgattgtaagtgatttaggcatataggtaggaattgtctatagacattttattcaatatcctatttatgtcctttttattttttgccctttttaactcttgaaaaaattttaaatctcatgcatagaaaagttacagataatttttttctttctgaaccatttgtgatttagttgaagacatgattcctcattactgattactatctgcttcaaattatcttacatgactacaatgcaaccattagaatcaggaaatttacgttgacacattactaccctctaatcctcagatcttcacttcattcacattgaactgattgtcccaataatgtccatatagcaagaggatccagtcagaatcatgcctttcatttagatgtcagctgtctttagtttacttcattctggaacaaattctcatttgtttccttttacaacttagtacttttgacaattatgggctagttttgtagaacaccccttattttgagttctgtctgatacttcatgattagattgaggttattcatctttggcaggaatgtgatagaagtgcatcctgtcattgtttaataatttcagtttgtctcatttctgatggtgtttcttagatgactgattaaggtagtgtctgccagacttctccactgtagttatttttataattatttcttgagaagatagttgcaaaatactaccttgtttctgatcagactttaaatttatcgtatctctataaactcattattttctattttattcagcaggttaaaaaacctattatcattacattggtgctcaaaattattgtacatttggctggtagaagtccattctgggtggcctctgtgtccttctgacacattcccatcattattcaatgaatttgttactctctggcataagatataccaggcttctcatgctgtcctcgacctaacccaagaatcagccatttttccgtagagcctgggttctctttagtgagtaatatttaaaagccaagatctgtgctagtgtgcaattgccgttggtgtgtatatataatgcatgtctttacatctatatttctgcatctatgtatattgaaaaccatgaattcacatataaattctgatcccatgggcttcattttcattttttccttctccacatttataaccgttttcagtaccagtgagaaacctgattcctatttgattatttgtggggttttttttttttaaggtggagtttcactcttgttgcccagactggagtgcagtcgcgcgatctcggcttactgcaacctccgcctcctgggttcaagcgattctcctgcctcagcctcccaagtagctgggattacaggcatgcgctgccacacctggctaatttttaatttttggtagagacggggtttctccatgttggtcaggctggtctcgaactccggacatcaggtgatccgcccgcctgggcctcccaaattgctgggattacaggtgtgagccactgcgcctggcctgattctctattgtaggtcatctccccacatgaatgtcttcctcaccctgcttaggcttcgcatcctatgctgagcaggaatgtcctcctcatcctgcctggaccctaatacctcactccaggccatggcagtccattcaccctgtgattcctatcttgctcattttaggaatgaattgtcgggggaagaggctatttttcttttaattttattctctttgacatttaacaaaattttttgagtaaagtaaaattaacttttttggtgtatggtttggtgaattttaagtatagatatgtgtaaacacctccacagtcagagtattgaagagttcaatcaccgtaaaaactctcgtgctctctttgtactctacacaccctactcccagcccctaaaccttggaaaccactgatctaatccccatctccatatttttgtcttcaagcatgttataaatgggatcatatataattaagaaaaacgctttattgtaacaacatacatttcacccatttaaggtgtgtaattcagtagcttttagtatatacacagataaatgcaaccattccaataatcaattttagaatgttttcatcacctcagatagaaaccttgtatagtttagcttttatccttctcctgtcatcccccgccatccatactacctcttttcatctcatagatttccttattctggacatttcatgtacatggaatcataatacgtggtctttggttactggcttccttcactttacatgtcttaagaggttcatctatattcgagcatgtatcagcacattcattagtatgtctgaaaatacttcattgtatggctgtagcactttgtttatacatttgtaagttggacattttgggtatttccaccctttggctgtcctgactaaagctgctataaacgtgtacaagtctttatgtgcatatgtgttttcatttcttacctaggagtagaatttttaggttatatgataactatgttaatcatttgaggagctgtcattgtttcccaaagcagctacatctttttactttcccaccagcagtgtatgcaggttccattttctctgcatccttgccaatacttgtttacctgacattttgattttagtcactctagtggatatgaaatgggatctctatctagttttggtttgctattctctgatactatgttgagcattctttcttgtgcttattggctatttgtgtatcttccttaaagcagtgtttattcaaattatttacccatttttttagttgtcttattgggtagtaagagtctttatatattctgggtacaagtctcttaccaggtatatgatttgtaatttctcctattctctctttactttgttgatagtgtcttttgaagcacagacttaattttgatgaagtcttatccatcatgccattggtggatcatgtttttggtgtcatgtctaggaaccttaaccccaggtcatgaggaatttttcttttttctttttttgactcacattctcactctgtcacccaggctggggtgcagtggcacaatctccactcactgcaacctctgcctgctgggttcaagtgattcttgtgcttcagtctcccaagtagctgggactacaggtgtgcaccaccactcccagcccattttttttttattttttatttttagtagagttgggatttcaccatataggctaggctggtcttgaactgacctcaacggatctgcccgcctcagcctctgaagtgctgggattacaggcatgagccaccgtgcccggcctatggatttttttcttctaaaaattttataaatttagttctacatttagatccgtgatccattttaggttaatttttgtataagctgtgaaatttaggtaggtttatttttttgcatatggatgttcagttgttttaaaatcgtctgttgaaaaactctccattccccattgagttgtcttttcacctttgtcagaaatcaattgctatttatgtgagtctggttttggactttattccatcgatctatgtgtttatcctttcataaataccagattgccttgattatcacagctttatagtaagtcttaaaactgggcagcatgattccttcaaaatttttttgaaatctttttcaaaattgttttggctaatttagtttctttgccttccatatgaattttagaattagctactctgtatctacaaaaaatcctactggggttttgaatgcaattttgtgtcttccaatccatgaacatgaggtatctatttaggacctctttcatttcagttatcagcattttatgtcatttttcagcatatattccacagtgttcattttggaggaactattgttaagttgtattatttttgaaacatgggtttccaattgcacatcgctagtatgtacaaatgtgtttgatttttgtttgttgaccttgtatcctgtgaccttgctaaacttcattagttttgggagttattttgttgttaactcattaagttttctacataaactacgaatagaaacagttttattttattctttttagtctatgatttttcttgcctgattttgttgttaactcattaagttttctacataaactacgaataggaacagttttattttattctttttagtctatgatttttcttgcctgattgcagtggccagaacaataacatggagaaagtggccatctcagtcttgttctggatcttaggattttgaaagcattgtttttgaccattatgtatgcaagctgtaggcttttcttaaattccctttgtcatgttgagcaagttcccatctattaatttgttgttagcagagtttcatgagtggatgctgaattttctatgctctttctgtatcagtttggtcattctttttgtttagactgttaaaatcatggattttactgattccagaattttgaaacagcttatatttcctcccaaccccaaacttggtcatggtacattattcagcttatgtatctagatttttattttttgaggatttttatgtctgtgttcattttggatattgtgcaattgtttttgtttgttttttccttgtgttatctttatcttggtatggtatcatgttaattctggtcttgtaaaatgaattgcaaagtgattattctttctggaagagatttgtagaatttgttatatctttaaatgttttatgaatttgctagtaaggttttaaacaatggttcaatttttaaaaatagagaatttattgaggtttatttaagtttgggtactgtatgcctttcaaggaattggttcatctaatcctatgtgcatagagttgttcatggtattttctttgtgtcgttctaatgaggatctatactgttatcttttctttgattcctaagattggaatcaaagattggaattccttctctttttttgtcaattttgccagaggtttatcaattttactgctcttttcaaaaattagttttttgattgttttctattaatttgtttacaattgcatttattttctgcctcttttttttttttcttctttctgcttgctttaggtttagtttgggcttcttttttttgtagacaggtctcacttcatcacccagactggagtagtgttatgatcatagctcactgcagcctcaaactcgtggggtcatgatcctcctacctcagccttctgagtggctgggactatagtggtgtgccaccacacccagttagattttcctactttcttaaagtgggagcttagagtgttaatttgagaactttttcttgtttagtaaaaagcagtcgattgttataaattgcagcaccagcatggctgcattccaagcacggtgatattttcatttattttaaaatattttttaagacttccctgtagtatcatgagttatttagaaatgtgttgtttaatttccaagtgtttggagattttcttgctgttactgatttctagattatggtcaaaaaacatattttatatgatttcatctcttttaaatttgttaaggtttaagacccatgatgtggtttatcttggtgagtgttccatgtgtacttgaaaagaatgcttattctgctgttttaggtagaagggttttatgtcaattaaatctagctggttattagtattattccattttcctacatctttgctaattttctattaattctatggactactgagagaggaatgtttaagtttccaactgtaaatgaagatttgtccagtcctccttttaatgctaccactttttgcttcatgtttttttttttttttttgagtcttaccctgtcactcaggctggagcatagcaactctgtcatgcttcactgcagcctcaaactcctgggctcagacagtcttcccacctcaggctcctcagtacctaggactacagatgtatatcactatgcctagctaatttttgattttttgtagagatagggtctccctatgttgagtaggctggtcttgaactcttggcctcaagcaatcctcccaccttggcttcccaaagcattggaattacaggaatgaatgagtctctgtacctggtctcttcatgtatttttaagatctgataataagtgcttacacttttagcactgtcttggtgaattttatcattatataatgtccctaattatccttggcaattttggttgttcctaactctactttgatgaatataaaaatggctttttaatttattttttgagacaagagcctcactctgttgcccaggttggagagcagtggtgtgatcttgtctcactgcctcacaggttcaagcaattctcctgcctcagtctctggagtaactggtactacaggcatgcgccaccacacccagctgatttttgtatttttagtagagatggggtttcaccatgttggccatgctggtctcgaactcctggcctcaagtgatccgtccaccttggcctcccaaagtgctgggattacaggtgtgagccactgcgctcggccttaaaaattggcttatcttttaattcatcttgactcatgtttactgttttttggtttctgaaaaatagatttaataaataataacattttatcaaagttattagtatagagaaataaattgagtgttgttattattctatgatcatgatgacagcacagaagttaatgtggccagcatatagttttgattaaaaattatacaagcaa

SEQ ID NO: 161507 - DNA, 448 bp, Homo sapiens
  Payload ID: 11529
  Gene Symbol: NUDCD2
  Gene Name: NudC domain containing 2
  ENST ID: ENST00000517501
  CDS Start-End: 6-404
ggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgcca

SEQ ID NO: 161508 - DNA, 8256 bp, Homo sapiens
  Payload ID: 11530
  Gene Symbol: NUDCD3
  Gene Name: NudC domain containing 3
  Uniprot ID: Q8IVD9
  ENST ID: ENST00000355451
  CDS Start-End: 281-1366
gccctcgcagcgcagcagaagccacgggcttccttccgcgtaggaacctccttgctgcccttgtcgggctcttttgtctaagaccacctcaaggcaaagcccgtggggcagctgggtctggggaaaacagcccggggccgcgggggccgaacgagcacggaccggaagttccgcagccgcgccgtccggcggagccgttggctgcggacgccggaagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaatatggatttgttaattttacctttttttttctttccaactttaggttcaagggttgttacatgggtaaattggatcataggggtttggtgtacagataattttgtcacccaggtaatcagcatgatacctgatatgtagtttttcagtcctcaccttcctcccactcggttttattttttagtactgaaagtttaacagattggtcttacctcagagggagggaagaaacccccccatcgctgggctccttggtgtgacaggggtctggtaggggttttcaatcccaccacccattcctccacaccaaatgcctgaagtccccactttgcacagggagacagcatcgtgccagggaagagaggtcaggcccggctacccctcacaacttcctgcttccccctcagagggtgatggggagaccagagcccatggcaggatgaactgtcactgaacccagctggcacaggtctgccagaacactctgggggtatgcgctgggctttctgggtaaacccctggcaagctggcgtttgctgtcttctcagtgctgatggagataggcacacatggggtgtgggaatgtggccaccctcaggcaggttcacgagggtactgtcaggcgctcaggtgtatgccgcctcctgtcaggcagggctgaggctattctccctggagaaggacagcttaggaaacacttgcaggaaagctgcctggacctgggaggtgaccctggccagcctccctgctgcctctctcagtcctaggccttcttccccagagctggtcagggcctgagggactttgtagtctaacccctcattgtgctacaatcacaggagtaagtaacactcccaaggccatgtggctggtgactcggggggcccaggtccaggatcctgccccatctgcaggccagtggttccttgtctcctatttgcttcttggagcagcctcctcataagccaacagctccttcacctgagcccagtcactttgcgctcctccccagaaccaaagagcaagaccatctgccccaggtacagtcctggccatgccacactctctgtggcatcatgaccaaggtgagtggcagatactgaaatcatccagggccactgcaggccccattcccagtggactgttcatcaagggaccctgtctcaggccatctcagccaaccttgttgcccagcacaggtctggcacattggagatgatctgtgttggatggggaaggcagagggaggatcctccagcattgatcacccatcaaaaccctcaacaacccagacattgccgctgcactgaccccatgctatgaggaggtcactcaggctgttaggagcctgctgactcaggcattgggctggggccctgcctgccttgtctgcctgccagcggagcactgccccaagcccttcttactgcagagacaggctcttgcctcccagtgtgcactttgtgcaagacacaggcaggtaagggtctaccagaggacaggaagtgttgttggggcactgtggggtttggaggaggcccctctagcagggaaagcgagccctaacctctgctggactagggagtttaggaagctgctctggttcagggaactggggatccagataactggggatcaaggccatcttgtgaccccagtggtggtccctagtgggactgctgagctccagcctgagagttcatgaactcaacagtgattgcttgtgggtactaatgacccagtgtgtggagacctcatttaccaggtgtgcctagcctgcaggcaaatcccaaggcagtgacccttagggaagagacagcgtttggggtcatcaaaggctgggaaacccaggtacctgtcagggaatgggctacagactggagctaagccttaaggtggggaagattccagcacccctgagtgaccacctcttttggtaatgcaaagaagggattttgtgactccagggtgacatttctaagcttggcatcatgcagggtgggcttgggctcaatatgggtgactgttagtctagggctgtctcaatgaggctgtccaggcagaaaggcttacacacctggcaggcagagggtctagagaggaaggggcaacaggcctaaggaggggacagccaggcaaggaggtagaataggccttgtctggacagtggtcacctgttaggtccacagcttgtcctccctggcctgaccagccaggtgaggagagatccaaaccatccacctgaaagcattcagggtgcctgatgacaagaccccagccactgtgggctctcatgtcctggtaggaaggtatacctaaagcaggtggacctggtagtggtggacgctgtctgcctccccggggcttgtctgtttatgccagaccgttttcccatttgcttccacctccagctcagagaggaatcaccttcacacctctgctaaaactaacccagctctgcacccaccattccccactgtgcaacacctgctactggagaaccctgccccctcaaatacacgtcatcctcagggccctgcgatgtgctgtggtctccctgccaccattcaaggggccacagccaggtccagcctgtcttccctggcaccaggctctatgcagtgggggaaactcgggcacccctaaactattctccagtgttctcaccagaggtggtcagccatgtgatggcaagagtcacttcttaagcttttgctatccccagaaacttaaagcaacaccaaccacacccaaaagtcaagtgatatccagacagcaacagtagagcattaactgagtgcagggccgtggtgactcctcgacactccaggctctcctgctggtaacctcccattggcagagccaggcactcagcaaagccctggacagtcagcagcctcctgaacaggctctgctgtccccactcacgacttcagagcagctaggactcctgtgaccacccctgtcccctgttcccccccaccccgccccgccccgccaactgcctcatctctgtcccaagataactgctctccagaattttccatgatatggtcattttaaaagttttttttttttttgagacagagtttttcctgtgttgcccagactggactcaaacctctgggctcaagtgatcctcctgcttcagcctcccaagtagctgggactgtaagtgtgcaccactgtgcctggcttgatggtgtcatttttcactgtacgtgtatttgtaaaccgtataaatcag

SEQ ID NO: 161509 - DNA, 1800 bp, Homo sapiens
  Payload ID: 11531
  Gene Symbol: NUDC
  Gene Name: nudC nuclear distribution protein
  Uniprot ID: Q9Y266
  ENST ID: ENST00000321265
  CDS Start-End: 124-1119
gtgtttccggctccgctgcggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaataaataaa

SEQ ID NO: 161510 - DNA, 816 bp, Homo sapiens
  Payload ID: 11531
  Gene Symbol: NUDC
  Gene Name: nudC nuclear distribution protein
  ENST ID: ENST00000452707
  CDS Start-End: 418-816
gcaaattatcgcatccctgagcttaggatccccctttagtttcacatatgcccccacccccgtttccactttgatggcggcttccaaggagcatcccttagtaagaaccgtcgcaaatatcgtgatttggatccaccaaggcttggggcgagccgtcgaatgtgtgtggtaggggagcgggctgatgttagcacgtggtcttgttaggccttgaatgggggaataggaggcctgtgttcacgattagtttccaccacctaccaacttggaacctttacatctctccaagcctgagtttccttatctgtgagacagctgcgaataccggtttccagagagtagttaagaacccttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggac

SEQ ID NO: 161511 - DNA, 821 bp, Homo sapiens
  Payload ID: 11531
  Gene Symbol: NUDC
  Gene Name: nudC nuclear distribution protein
  ENST ID: ENST00000435827
  CDS Start-End: 264-821
taggaattagggcagagttaggagcggcctgcggaggggcccgctcaggccgatgccggtagtggaaacagaggaagccaccgccgcgctcttctcggaactggctaaaatagctccgtaaatgggccgagcgcaacacggaggggataccgctcactaccagcttcccgaactttggcttaccctcagcttgagccagcgcacatctcctccttaacagcctctcctgagaataggctggcttcaaggaatgggggaagtgaatgatctcaaactacagaaatggcagtgaacttgtctgtttcaattcgggagtgggctgcttcctgattggctgtgattgggctttcactgtgcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggac

SEQ ID NO: 161512 - DNA, 3166 bp, Homo sapiens
  Payload ID: 11532
  Gene Symbol: NDE1
  Gene Name: nudE neurodevelopment protein 1
  Uniprot ID: Q9NXR1
  ENST ID: ENST00000342673
  CDS Start-End: 57-1064
ccttctctcctagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaa

SEQ ID NO: 161513 - DNA, 3221 bp, Homo sapiens
  Payload ID: 11532
  Gene Symbol: NDE1
  Gene Name: nudE neurodevelopment protein 1
  Uniprot ID: Q9NXR1
  ENST ID: ENST00000396354
  CDS Start-End: 112-1119
ggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaa

SEQ ID NO: 161514 - DNA, 3936 bp, Homo sapiens
  Payload ID: 11532
  Gene Symbol: NDE1
  Gene Name: nudE neurodevelopment protein 1
  Uniprot ID: Q9NXR1
  ENST ID: ENST00000396355
  CDS Start-End: 827-1834
ggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacgacggagtcttgccctgtcgcctaggctagagtgcagtggtgtgatctcggctcactgcaaccgccacctcccggtttcccgtgattctcctgcctcagcctcctgagtagctgggattacagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaa

SEQ ID NO: 161515 - DNA, 411 bp, Homo sapiens
  Payload ID: 11532
  Gene Symbol: NDE1
  Gene Name: nudE neurodevelopment protein 1
  ENST ID: ENST00000573694
  CDS Start-End: 1-411
cgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggttggggaagcgcctggaatttgggaagccgccttcacacatgtcttcatcgccgctgccgtcagcccagggggtagtcaagatgttgctttaggaaaaccacggaagctgaaggtcttggtgttggttggacacgagttgccgctggttgtccaaat

SEQ ID NO: 161516 - DNA, 843 bp, Homo sapiens
  Payload ID: 11532
  Gene Symbol: NDE1
  Gene Name: nudE neurodevelopment protein 1
  ENST ID: ENST00000574109
  CDS Start-End: 1-522
gaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagt

SEQ ID NO: 161517 - DNA, 588 bp, Homo sapiens
  Payload ID: 11532
  Gene Symbol: NDE1
  Gene Name: nudE neurodevelopment protein 1
  ENST ID: ENST00000570727
  CDS Start-End: 208-588
agccgcctctgccgccgccgccgcgttggcctcgccgcccctgctcggagtctcactctcgcccaggttggagtgcagtggtgcgattttggctcactgcaacctccgcttcccgggttcaagcgattctcctgcctcagcctccggagtagctgggactacagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagcc

SEQ ID NO: 161518 - DNA, 484 bp, Homo sapiens
  Payload ID: 11532
  Gene Symbol: NDE1
  Gene Name: nudE neurodevelopment protein 1
  ENST ID: ENST00000572967
  CDS Start-End: 1-420
gccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggggaagcgcctggaatttgggaagccgccttcacacatgtcttcatcgccgctgccgtcagcccagggggtagtcaagatgttgctttaggaaaaccacggaagctgaaggtcttggtgttggttggacacgagttgccgctggttgtccaaat

SEQ ID NO: 161519 - DNA, 915 bp, Homo sapiens
  Payload ID: 11532
  Gene Symbol: NDE1
  Gene Name: nudE neurodevelopment protein 1
  ENST ID: ENST00000572756
  CDS Start-End: 212-590
agccgcctctgccgccgccgccgcgttggcctcgccgcccctgctcggacggagtcttgttcttgtccaggctggagtgcagtggcatgatctcgactcactgcaacctcagtcctccgggttcaagtgattcttctgcctcaccctcctgagtagctgggattacagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtgg

SEQ ID NO: 161520 - DNA, 762 bp, Homo sapiens
  Payload ID: 11532
  Gene Symbol: NDE1
  Gene Name: nudE neurodevelopment protein 1
  ENST ID: ENST00000573203
  CDS Start-End: 82-411
gccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggttccgaggagatctctcaatcgccagtgcagtcggtggagcccactcgctgcgtcctcctggagcctgcgtttgaatttaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctga

SEQ ID NO: 161521 - DNA, 575 bp, Homo sapiens
  Payload ID: 11532
  Gene Symbol: NDE1
  Gene Name: nudE neurodevelopment protein 1
  ENST ID: ENST00000577101
  CDS Start-End: 1-575
atgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcgggaggtttaacaaggtaaaccaaagggtgaaggattccagaagtggatttcctacttcctacaagcggagttggataattggtaggcactggagtccaaactcgcttcctgccggaacctcgtgtacgatcagtccccaaacc

SEQ ID NO: 161522 - DNA, 1131 bp, Homo sapiens
  Payload ID: 11532
  Gene Symbol: NDE1
  Gene Name: nudE neurodevelopment protein 1
  ENST ID: ENST00000576502
  CDS Start-End: 1-462
cccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttgagacagagtcatgctcttgccctgtcttg

SEQ ID NO: 161523 - DNA, 3166 bp, Homo sapiens; identical to SEQ ID NO: 161512
  Payload ID: 11532
  Gene Symbol: NDE1
  Gene Name: nudE neurodevelopment protein 1
  Uniprot ID: Q9NXR1
  ENST ID: ENST00000619489
  CDS Start-End: 57-1064

SEQ ID NO: 161524 - DNA, 484 bp, Homo sapiens; identical to SEQ ID NO: 161518
  Payload ID: 11532
  Gene Symbol: NDE1
  Gene Name: nudE neurodevelopment protein 1
  ENST ID: ENST00000632452
  CDS Start-End: 1-420

SEQ ID NO: 161525 - DNA, 588 bp, Homo sapiens; identical to SEQ ID NO: 161517
  Payload ID: 11532
  Gene Symbol: NDE1
  Gene Name: nudE neurodevelopment protein 1
  ENST ID: ENST00000632288
  CDS Start-End: 208-588

SEQ ID NO: 161526 - DNA, 1131 bp, Homo sapiens; identical to SEQ ID NO: 161522
  Payload ID: 11532
  Gene Symbol: NDE1
  Gene Name: nudE neurodevelopment protein 1
  ENST ID: ENST00000634195
  CDS Start-End: 1-462

SEQ ID NO: 161527 - DNA, 3936 bp, Homo sapiens; identical to SEQ ID NO: 161514
  Payload ID: 11532
  Gene Symbol: NDE1
  Gene Name: nudE neurodevelopment protein 1
  Uniprot ID: Q9NXR1
  ENST ID: ENST00000631923
  CDS Start-End: 827-1834

SEQ ID NO: 161528 - DNA, 3221 bp, Homo sapiens; identical to SEQ ID NO: 161513
  Payload ID: 11532
  Gene Symbol: NDE1
  Gene Name: nudE neurodevelopment protein 1
  Uniprot ID: Q9NXR1
  ENST ID: ENST00000631844
  CDS Start-End: 112-1119

SEQ ID NO: 161529 - DNA, 843 bp, Homo sapiens; identical to SEQ ID NO: 161516
  Payload ID: 11532
  Gene Symbol: NDE1
  Gene Name: nudE neurodevelopment protein 1
  ENST ID: ENST00000632668
  CDS Start-End: 1-522

SEQ ID NO: 161530 - DNA, 575 bp, Homo sapiens; identical to SEQ ID NO: 161521
  Payload ID: 11532
  Gene Symbol: NDE1
  Gene Name: nudE neurodevelopment protein 1
  ENST ID: ENST00000633132
  CDS Start-End: 1-575

SEQ ID NO: 161531 - DNA, 411 bp, Homo sapiens; identical to SEQ ID NO: 161515
  Payload ID: 11532
  Gene Symbol: NDE1
  Gene Name: nudE neurodevelopment protein 1
  ENST ID: ENST00000631507
  CDS Start-End: 1-411

SEQ ID NO: 161532 - DNA, 915 bp, Homo sapiens; identical to SEQ ID NO: 161519
  Payload ID: 11532
  Gene Symbol: NDE1
  Gene Name: nudE neurodevelopment protein 1
  ENST ID: ENST00000632578
  CDS Start-End: 212-590

SEQ ID NO: 161533 - DNA, 762 bp, Homo sapiens; identical to SEQ ID NO: 161520
  Payload ID: 11532
  Gene Symbol: NDE1
  Gene Name: nudE neurodevelopment protein 1
  ENST ID: ENST00000631789
  CDS Start-End: 82-411

SEQ ID NO: 161534 - DNA, 2372 bp, Homo sapiens
  Payload ID: 11533
  Gene Symbol: NDEL1
  Gene Name: nudE neurodevelopment protein 1-like 1
  Uniprot ID: Q9GZM8
  ENST ID: ENST00000334527
  CDS Start-End: 198-1235
agaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 161535 - DNA, 2181 bp, Homo sapiens
  Payload ID: 11533
  Gene Symbol: NDEL1
  Gene Name: nudE neurodevelopment protein 1-like 1
  ENST ID: ENST00000380025
  CDS Start-End: 159-968
gggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtagggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 161536 - DNA, 1858 bp, Homo sapiens
  Payload ID: 11533
  Gene Symbol: NDEL1
  Gene Name: nudE neurodevelopment protein 1-like 1
  Uniprot ID: Q9GZM8
  ENST ID: ENST00000402554
  CDS Start-End: 151-1137
ccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctg

SEQ ID NO: 161537 - DNA, 588 bp, Homo sapiens
  Payload ID: 11533
  Gene Symbol: NDEL1
  Gene Name: nudE neurodevelopment protein 1-like 1
  ENST ID: ENST00000582812
  CDS Start-End: 152-588
atttcccatccttgcgtatctttggtcggacggtgattctcactcttcctattgacttctactttgtgtcagcaagttcagcgtgggccccgtatgctgccgtggatctgatcagctgaggcctgagacacaggaccaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggc

SEQ ID NO: 161538 - DNA, 577 bp, Homo sapiens
  Payload ID: 11533
  Gene Symbol: NDEL1
  Gene Name: nudE neurodevelopment protein 1-like 1
  ENST ID: ENST00000584866
  CDS Start-End: 478-577
gcggaggtacgctgagtggagctcggggctgcgtaggggagctgagccgagcggctgggcgggcctggccgggccggcggaggggagacgtcggttgagcggcggcgaacatgcgcttttgacacattggagaagaccacgtggccttaaaccaactgctgcaactctgtgtgcaggatgattctgtgggcccaagtcacccagcgcctatgctgcaaccaaaagtgcctcctgtcgctttgtatcaaaggacctttgtcatgatctcattcacaatattggtggtccctgagagtggagcagtggagtgattgacgtgcctgagtttgaagagagttaaccactggaatctctcatgttttattccctccaaaatgctgcagttcagtgttgtcccagattttatgcttgtgcttagatttctctgttctctaatttgttaagtttgtctttaatatttcacaggctttcttgatcatggatggtgaagatataccagatttttcaagtttaaaggaggaaactgcttattggaaggaactttccttgaagtataagcaaagcttccaggaagctc

SEQ ID NO: 161539 - DNA, 602 bp, Homo sapiens
  Payload ID: 11533
  Gene Symbol: NDEL1
  Gene Name: nudE neurodevelopment protein 1-like 1
  ENST ID: ENST00000582490
  CDS Start-End: 387-602
acgctgagtggagctcggggctgcgtaggggagctgagccgagcggctgggcgggcctggccgggccggcggaggggagacgtcggttgagcggcggcgaacatgcgcttttgacacattggagaagaccacgtggccttaaaccaactgctgcaactctgtgtgcaggatgattctgtgggcccaagtcacccagcgcctatgctgcaaccaaaagtgcctcctgtcgctttgtatcaaaggacctttgtcatgatctcattcacaatattggtggtccctgagagtggagcagtggagtgattgacgtgcctgagtttgaagagagttaaccactggaatctctcatgttttattccctccaaaatgctgcagctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactg

SEQ ID NO: 161540 - DNA, 790 bp, Homo sapiens
  Payload ID: 11533
  Gene Symbol: NDEL1
  Gene Name: nudE neurodevelopment protein 1-like 1
  ENST ID: ENST00000580012
  CDS Start-End: 614-790
cggcgccgaggcctgcccttggggagccttcccggcccggggccgtgtctgaggctccgccggggcgggccgggccgggttccggggcggccagcctgggggcaactgttccaaccgctctaactgtcccctcccttccctggtccgatgtgtggccccccaggggcgcctgcaagggaacgattccggtggcctccggaagatgtgccccgttccgggtagggtgagggctggcggtgacggaggccgggacgtggcaccgtgggctggggcgctggcggcgcaaggagtggcccagtcggaggtggcagcggcgcgcccagcccgcctcctcctaccccctcttcgaaattccttcatttgcgagggtggcttggagcggggttgcattttgatctctcagtgcctctctcccatggggggcgagagcgcgagcagcccacgttgggctcggattggcattctcctgactcccgcccggaactgctaatcatcctccccctggagttcggcaaagtgtcaccaacgggctcgggttacttgtgctcgactcttttcttgctgtaagccatgagatgaccctttaagttttgcaaaggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaa

SEQ ID NO: 161541 - DNA, 555 bp, Homo sapiens
  Payload ID: 11533
  Gene Symbol: NDEL1
  Gene Name: nudE neurodevelopment protein 1-like 1
  ENST ID: ENST00000582665
  CDS Start-End: 81-555
gtgcgtcacagaatggcctcggacacccaggcagtccctgacgtgtcggggaggagccgggcgcggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatg

SEQ ID NO: 161542 - DNA, 454 bp, Homo sapiens
  Payload ID: 11533
  Gene Symbol: NDEL1
  Gene Name: nudE neurodevelopment protein 1-like 1
  ENST ID: ENST00000585098
  CDS Start-End: 165-422
gtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgcatgcagtggcggctactgggccctgcccagccccggaactctgcgcgatatcaatactggctattttctcttctcgccgtagtgccgttggtttcacatgattgcacttttgtg

SEQ ID NO: 161543 - DNA, 577 bp, Homo sapiens
  Payload ID: 11533
  Gene Symbol: NDEL1
  Gene Name: nudE neurodevelopment protein 1-like 1
  ENST ID: ENST00000580237
  CDS Start-End: 88-318
tgtgtcagcaagttcagcgtgggccccgtatgctgccgtggatctgatcagctgaggcctgagacacaggaccaggctttcttgatcatggatggtgaagatataccagatttttcaagtttaaaggaggaaactgcttattggaaggaactttccttgaagtataagcaaagtaggcggggccatctttggcccgttttgcatgcactgattctgcctcatcattttggtcatttggagattctgataagctgtctggggctccatagaacagactttacgttctcctcagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacga

SEQ ID NO: 161544 - DNA, 749 bp, Homo sapiens
  Payload ID: 11533
  Gene Symbol: NDEL1
  Gene Name: nudE neurodevelopment protein 1-like 1
  ENST ID: ENST00000582277
  CDS Start-End: 1-589
acgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggcagagcaggtacaactctagaaacgctcacaatctctgaaagcagctgggattttctgccgtcctcaataattatggcacatgtgtaaaggagcagattcgacacacggtgcactctgaataggctcttatccttgcagtggagtgttttggttgatctctgtccctgattttaccctggagaatatacatttcattaaggattttgtattaaaagcacatcctaaaacatcactatacaaattagaa

SEQ ID NO: 161545 - DNA, 582 bp, Homo sapiens
  Payload ID: 11533
  Gene Symbol: NDEL1
  Gene Name: nudE neurodevelopment protein 1-like 1
  ENST ID: ENST00000581679
  CDS Start-End: 1-582
tttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggatgtgttctaacacgaatgaacaggatactgacccagagctgggctttgagagcctgcaccccttgttgtggaggccgcaccctctgccctacctgtttgatcagcagccgcttcttctcttcattctgctcatccctggtttgcaggtctctctcgaactgcgc

SEQ ID NO: 161546 - DNA, 771 bp, Homo sapiens
  Payload ID: 11534
  Gene Symbol: NUDT1
  Gene Name: nudix (nucleoside diphosphate linked moiety X)-type motif 1
  Uniprot ID: P36639
  ENST ID: ENST00000343985
  CDS Start-End: 88-627
agggctttctgtatccctaggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 161547 - DNA, 698 bp, Homo sapiens
  Payload ID: 11534
  Gene Symbol: NUDT1
  Gene Name: nudix (nucleoside diphosphate linked moiety X)-type motif 1
  Uniprot ID: P36639
  ENST ID: ENST00000339737
  CDS Start-End: 84-554
agggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 161548 - DNA, 662 bp, Homo sapiens
  Payload ID: 11534
  Gene Symbol: NUDT1
  Gene Name: nudix (nucleoside diphosphate linked moiety X)-type motif 1
  Uniprot ID: P36639
  ENST ID: ENST00000356714
  CDS Start-End: 48-518
ggtcagaggccacgcccccggaagcggcggtgcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 161549 - DNA, 712 bp, Homo sapiens
  Payload ID: 11534
  Gene Symbol: NUDT1
  Gene Name: nudix (nucleoside diphosphate linked moiety X)-type motif 1
  Uniprot ID: P36639
  ENST ID: ENST00000397046
  CDS Start-End: 98-568
acgaaaagcgcgcgcggggattccaggagtcgtggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 161550 - DNA, 783 bp, Homo sapiens
  Payload ID: 11534
  Gene Symbol: NUDT1
  Gene Name: nudix (nucleoside diphosphate linked moiety X)-type motif 1
  Uniprot ID: P36639
  ENST ID: ENST00000397048
  CDS Start-End: 100-639
gaaaagcgcgcgcggggattccaggagtcgtggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 161551 - DNA, 714 bp, Homo sapiens
  Payload ID: 11534
  Gene Symbol: NUDT1
  Gene Name: nudix (nucleoside diphosphate linked moiety X)-type motif 1
  Uniprot ID: P36639
  ENST ID: ENST00000397049
  CDS Start-End: 100-570
cagagcacgtccccttcctcctggcccctggcacgtgcttcctccacgcacgtcatggctgactctgccctctcaccttcctttcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 161552 - DNA, 822 bp, Homo sapiens
  Payload ID: 11534
  Gene Symbol: NUDT1
  Gene Name: nudix (nucleoside diphosphate linked moiety X)-type motif 1
  ENST ID: ENST00000454650
  CDS Start-End: 712-822
gattccaggagtcgtggtgaccagggaggggagccgggccagcgggcggcaggagactaggggagctgagccatgggcttgggggagagcggggccgggagctcgaaggagaccagaagagcagggtcgggggctcgagggagacgaggagagcggggccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggc

SEQ ID NO: 161553 - DNA, 1917 bp, Homo sapiens
  Payload ID: 11535
  Gene Symbol: NUDT10
  Gene Name: nudix (nucleoside diphosphate linked moiety X)-type motif 10
  Uniprot ID: Q8NFP7
  ENST ID: ENST00000356450
  CDS Start-End: 137-631
gacggaggcgcctctctctccccgcccctctcctcggccctttctcttcccagcacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 161554 - DNA, 2001 bp, Homo sapiens
  Payload ID: 11535
  Gene Symbol: NUDT10
  Gene Name: nudix (nucleoside diphosphate linked moiety X)-type motif 10
  Uniprot ID: Q8NFP7
  ENST ID: ENST00000376006
  CDS Start-End: 221-715
tgagtaagccagaatggttgatagtgggggaggatgatgacgacgctgcctttgcccctgtcttgtgtgaaacaactgcctgtgggtttcctgcagcgcagtggggagtgagaggagaaacgtcctgccgtgccacacacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 161555 - DNA, 2385 bp, Homo sapiens
  Payload ID: 11536
  Gene Symbol: NUDT11
  Gene Name: nudix (nucleoside diphosphate linked moiety X)-type motif 11
  Uniprot ID: Q96G61
  ENST ID: ENST00000375992
  CDS Start-End: 153-647
gggcagacggaggcgcctctctttccccgcccctcgcctcggccctttctcttcccagcacctcggctgttccccggcggcggcagcggcagcggcggcccacacagcagcgagaggcgagaggaggctgcctcgaggaggctgcctcgaggatgaagtgcaaacccaaccagacgcggacctacgaccccgaggggttcaagaagcgggcggcgtgcctgtgcttccggagcgaacgcgaggacgaggtcctgttagtgagtagcagccggtacccggaccgctggatcgtgccgggcgggggcatggagcccgaggaggagccgggcggtgcggcggtccgagaggtgtacgaagaagcgggagtcaaggggaagttaggccggctcctgggcgtcttcgaacagaaccaggatcgcaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctaatgaacagcaaagatgttcagtattgtgctgaaagaaacattgatgtgaacccagtgatcagtggaattgtcaagtacaggtgagcacttctgtgttcccaagaagacagctcatctggtttcttcctgcatcttgggacactccttccctgtctataccactgactcttgctctggttgttgtactcttatacgtgaatagactcttaattcagcacctatagccttttgttgtgcttttttgatgtgtctgccttcattagactatgatgtctttgagagcaaagactatttttccttactctttgcatattctgcatctgagacactacttgaaatatggttggcatcactgaaggttctttgattcaattaatattttgtaatcaccgtgtggcaaaacattccccttccaatctggtgctagtagagtatatgctatctaggcaccatgtgtgtggcttttgtgtatcaggtgtttcagaaatatttcaagacagttgtaagatgtttgaggacaagaattattactcctatttctatgtcataccacacagtagctgcacagttttaagattatgccatcacctagggtaatgttttgtagaatcagtccttcgtgtaacaactctagtgtttttgtactgttgatgatttgcttaaattttattcaaaaactatcacttgctataaaggtaattgtaaaaataaatacagtggacgcaaaataatgttgtgagtttttataaaaataaattttaaaatgatatataagacatttttttgcaatgcctgccctaaccacttcttacatgtcatcttaacatctctttgaggaaacactgtttcctcattttacagatttaacatactgtattatttgatgccagagccaacaggctatatcataggcagtttccaaacttaattatgccatttagtttgtctagatttcttttgcctctctcactgatccatttggctgtagttttcatcccttttccagtacacacagctagctcctcatcctacctggtttctgcatatgagaatgcagagggctgagagagggcaaaattgttgtcatttagaaaaggcatttaggaaagaggctgctattagaggggaacacaaagtgaaggtttttttaaaaaagaggacttgcatcagctgcctccagaacaattttaagaaaataacaaagatgtttagaagaaatcttacggagtttgccatgggatgtgtgatatcagcagtcttcagctccttacaaattaccaaaagtggttctaatatgctagtttgtttgattttttcttttatattataaagcaattgcatcgataaaagcttggactccattttagtgtgacactcttcctcatgataccagtgaaatgtattgattgtgtccccagttgttacataatttgaaataaaaatataacttcttgatttattgttttttaagatgtgatatggtactgtggttatgttgttttaaaaaatgattatcttttagagaagtatactgaaaaatgtacaggtgaaatgatatgttactggtattcgcttcaaaatcatctgagtgtggggtaattgagtacatagatgaaacaagattggccataaattggtaattgctgaagctgtgtgatggatgtttgagagttcattatactattctctatacttttgtatatgtttgaaattttccataataaaaattgaaaaaagta

SEQ ID NO: 161556 - DNA, 3492 bp, Homo sapiens
  Payload ID: 11537
  Gene Symbol: NUDT12
  Gene Name: nudix (nucleoside diphosphate linked moiety X)-type motif 12
  Uniprot ID: Q9BQG2
  ENST ID: ENST00000230792
  CDS Start-End: 98-1486
cgggaagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtatgcggcaaggaatgggcacccagagatagtccaatttctgcttgagaaagggtgtgacagatcaattgtcaataaatcaaggcagactgcactggacattgctgtattttggggttataagcatatagctaatttactagctactgctaaaggtgggaagaagccttggttcctaacgaatgaagtggaagaatgtgaaaattattttagcaaaacactactggaccggaaaagtgaaaagagaaataattctgactggctgctagctaaagaaagccatccagccacagtttttattcttttctcagatttaaatcccttggttactctaggtggcaataaagaaagtttccaacagccagaagttaggctttgtcagctgaactacacagatataaaggattatttggcccagcctgagaagatcaccttgatttttcttggagtagaacttgaaataaaagacaaactacttaattatgctggtgaagtcccgagagaggaggaagatggattggttgcctggtttgctctaggtatagatcctattgctgctgaagaattcaagcaaagacatgaaaattgttactttcttcatcctcctatgccagcccttctgcaattgaaagaaaaagaagctggggttgtagctcaagcaagatctgttcttgcctggcacagtcgatacaagttttgcccaacctgtggaaatgcaactaaaattgaagaaggtggctataagagattatgtttaaaagaagactgtcctagtctcaatggcgtccataatacctcatacccaagagttgatccagtagtaatcatgcaagttattcatccagatgggaccaaatgccttttaggcaggcagaaaagatttcccccaggcatgtttacttgccttgctggatttattgagcctggagagacaatagaagatgctgttaggagagaagtagaagaggaaagtggagtcaaagttggccatgttcagtatgttgcttgtcaaccatggccaatgccttcctccttaatgattggttgcttagctctagcagtgtctacagaaattaaagttgacaagaatgaaatagaggatgcccgctggttcactagagaacaggtcctggatgttctgaccaaagggaagcagcaggcattctttgtgccaccaagccgagctattgcacatcaattaatcaaacactggattagaataaatcctaatctctaaatctaagaactaagctttgagtattatttaataatttctaataacactcattcctcaagtgatattagagattattcagtactcttgagagtgtcacaacacaaaatacgatgttgggttttcgaaatattttcaaagtgttctgtcttaatcacaaattcatatttttacacatttttacaatattgcctcagattatgttaaatttgggtcagtcttctctgaactttttctctcttggtttcttttcttccttcacagttttatctcacaaaaccatttttctaataagagacatcatgttggaaagatgttctagaaatgtgcataaatttcagtgcctcttgtaagcattaaactgatgatgaagaaagttcctgatttgagaaatgaatcaaagtaattttaatgaatttttagcttgtattagcttgagttagctggcattgattttttagtccttttgttacctttaagttgtcaatatatggtttttgttcatctccccattgtagtcccacttgctctttcctgggggttccattgttctagcagtggaggtgttatagtgtcgccactcgtctaatttgaccagtgttaagaattttctaatttaataatttaatagtgatctcaataccacaccctcatggaaggagaaaagcatactattatatctgggacctctcttttagacctaaaattaattaacatatctacttatatgttacttatacctaaagctgttattaagacaaaccaagattctctgcttttgcactgaaattaaacttgaaaggaattctcctcaaaggtcggatattaaataagtcccaggcagatttacatatttaatttaaaacattggctttatttcattttgtgatgagtgatgtatctgtgttaacaaaaaattgtataatcattaccaatactatttattatgctcaaatatatcttggctttgaccttatttcaacacattctaagaagccttgacaaagtaagtatattttagagctgaatcagtaagattctagagaaagcaaaacatagtagttcacaattttgcaacatagaaagtcacattttgaaaggctattttgaaattgatttaatagctattatagtttatgaatatcaaaatttgtataatttgcatctttactaatgtatgctagagctacaagagaccttaaggataatatatgaaattagctttccttattttatagataaggaaaaagaaattgtgaaaggtgaatttacctaattagtgaaagttacataactaattacaacagtctgtactatataatgcagaggacgattctccctgtaaaaggaactagaagctattactaaaaatatatatagacaaaattaaaagaaggaatgataagaataaatttaatttaccaaatattgttaattaaaattttagatacttaacatttatttaacttaaataaaagataactgtcagataaaactttattttactaatgagcagtgattttcttaggaattgatgaaggcttattggtatcaagaatttaaaccaaattaaaactgacagaggacatttagatacataataaaattcgagctacataagtatatggaaaataatgtaccttgattattatgaaatagagcatcttgaaattcagttttactctaaatgtacttttaatacttgcagattctaagattacattgtaaaattccaggttttcataatgttaaaataggaaagtagaatataaagtatcaacaagtgtagttatacattttgttttggatatttaatccttacttgggaaaaaatcagcatctaggtaaattattattttaataacaactcttaaattgccaacctctgagaggtgaaaagctatgtaaatagaaggaatggccagttcaaaagaatagtagatgtgatagtgccgtgaatgtattctactggaaatgaatgtaataatacattaaatttttaaaatcta

SEQ ID NO: 161557 - DNA, 1781 bp, Homo sapiens
  Payload ID: 11537
  Gene Symbol: NUDT12
  Gene Name: nudix (nucleoside diphosphate linked moiety X)-type motif 12
  ENST ID: ENST00000507423
  CDS Start-End: 94-1428
aagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtgtgacagatcaattgtcaataaatcaaggcagactgcactggacattgctgtattttggggttataagcatatagctaatttactagctactgctaaaggtgggaagaagccttggttcctaacgaatgaagtggaagaatgtgaaaattattttagcaaaacactactggaccggaaaagtgaaaagagaaataattctgactggctgctagctaaagaaagccatccagccacagtttttattcttttctcagatttaaatcccttggttactctaggtggcaataaagaaagtttccaacagccagaagttaggctttgtcagctgaactacacagatataaaggattatttggcccagcctgagaagatcaccttgatttttcttggagtagaacttgaaataaaagacaaactacttaattatgctggtgaagtcccgagagaggaggaagatggattggttgcctggtttgctctaggtatagatcctattgctgctgaagaattcaagcaaagacatgaaaattgttactttcttcatcctcctatgccagcccttctgcaattgaaagaaaaagaagctggggttgtagctcaagcaagatctgttcttgcctggcacagtcgatacaagttttgcccaacctgtggaaatgcaactaaaattgaagaaggtggctataagagattatgtttaaaagaagactgtcctagtctcaatggcgtccataatacctcatacccaagagttgatccagtagtaatcatgcaagttattcatccagatgggaccaaatgccttttaggcaggcagaaaagatttcccccaggcatgtttacttgccttgctggatttattgagcctggagagacaatagaagatgctgttaggagagaagtagaagaggaaagtggagtcaaagttggccatgttcagtatgttgcttgtcaaccatggccaatgccttcctccttaatgattggttgcttagctctagcagtgtctacagaaattaaagttgacaagaatgaaatagaggatgcccgctggttcactagagaacaggtcctggatgttctgaccaaagggaagcagcaggcattctttgtgccaccaagccgagctattgcacatcaattaatcaaacactggattagaataaatcctaatctctaaatctaagaactaagctttgagtattatttaataatttctaataacactcattcctcaagtgatattagagattattcagtactcttgagagtgtcacaacacaaaatacgatgttgggttttcgaaatattttcaaagtgttctgtcttaatcacaaattcatatttttacacatttttacaatattgcctcagattatgttaaatttgggtcagtcttctctgaactttttctctcttggtttcttttcttccttcacagttttatctcacaaaaccatttttctaataagagacatcatgttggaaagatgttctagaaatgtgcataaatttcagtgcctcttgtaagca

SEQ ID NO: 161558 - DNA, 1835 bp, Homo sapiens
  Payload ID: 11538
  Gene Symbol: NUDT13
  Gene Name: nudix (nucleoside diphosphate linked moiety X)-type motif 13
  Uniprot ID: Q86X67
  ENST ID: ENST00000349051
  CDS Start-End: 119-910
gcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 161559 - DNA, 2102 bp, Homo sapiens
  Payload ID: 11538
  Gene Symbol: NUDT13
  Gene Name: nudix (nucleoside diphosphate linked moiety X)-type motif 13
  Uniprot ID: Q86X67
  ENST ID: ENST00000357321
  CDS Start-End: 119-1177
gcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 161560 - DNA, 1919 bp, Homo sapiens
  Payload ID: 11538
  Gene Symbol: NUDT13
  Gene Name: nudix (nucleoside diphosphate linked moiety X)-type motif 13
  Uniprot ID: Q86X67
  ENST ID: ENST00000372997
  CDS Start-End: 48-755
tcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacaggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 161561 - DNA, 2151 bp, Homo sapiens
  Payload ID: 11538
  Gene Symbol: NUDT13
  Gene Name: nudix (nucleoside diphosphate linked moiety X)-type motif 13
  ENST ID: ENST00000537969
  CDS Start-End: 759-1226
ctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacgattgaatgagggtcactgaagatacagtgtttactctttgtctgctgtgaaaaagtctgttcccatctctaggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 161562 - DNA, 2258 bp, Homo sapiens
  Payload ID: 11538
  Gene Symbol: NUDT13
  Gene Name: nudix (nucleoside diphosphate linked moiety X)-type motif 13
  Uniprot ID: Q86X67
  ENST ID: ENST00000544879
  CDS Start-End: 653-1333
ctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacgattgaatgagggtcactgaagatacagtgtttactctttgtctgctgtgaaaaagtctgttcccatctctaggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 161563 - DNA, 928 bp, Homo sapiens
  Payload ID: 11538
  Gene Symbol: NUDT13
  Gene Name: nudix (nucleoside diphosphate linked moiety X)-type motif 13
  ENST ID: ENST00000617744
  CDS Start-End: 203-928
ctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatatagcctacagggctgtcctgaattaa

SEQ ID NO: 161564 - DNA, 845 bp, Homo sapiens
  Payload ID: 11539
  Gene Symbol: NUDT14
  Gene Name: nudix (nucleoside diphosphate linked moiety X)-type motif 14
  Uniprot ID: O95848
  ENST ID: ENST00000392568
  CDS Start-End: 95-763
gtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcgtgaccgttctcttattcaactcttctcggaggagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 161565 - DNA, 527 bp, Homo sapiens
  Payload ID: 11539
  Gene Symbol: NUDT14
  Gene Name: nudix (nucleoside diphosphate linked moiety X)-type motif 14
  ENST ID: ENST00000546553
  CDS Start-End: 104-394
agagccgcggtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagtcacccggcctcagctgcgagcaccctgacctactcagctgcccgtgtgtccttccctgccccccgcctcccatcctgccagctggaatacagcaggtctgggtcctggccagactgtgaccctggaaagctctggtcccgcctgggcctcagccatcctatctgagcaaggggcctgacctccctgggctgctggcaaggagcgtgaccgttctcttattcaactcttctcggaggagcctggtgttggtgaagcagttccggccagctgtgtatgcgggtgaggtggagcgccgctt

SEQ ID NO: 161566 - DNA, 2098 bp, Homo sapiens
  Payload ID: 11540
  Gene Symbol: NUDT15
  Gene Name: nudix (nucleoside diphosphate linked moiety X)-type motif 15
  Uniprot ID: Q9NV35
  ENST ID: ENST00000258662
  CDS Start-End: 181-675
attccccaacctgatagccctccgcgacgcattacgcaccgcggacagctggagaggccgaggcgctctcgctttgatttcggcgcctccgccctcgcggggagagattggctgcggccgcgggacggggtagtgagcgcgtcacttcctgccgctgccaggcgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctgttgcaaaatttaccaaatttgttgattacctcttttattaaagaaatgttggggagagggtaatatattgtgacaatttttgcaacttacagggaataggacaggtcattagggtgtatttcccaggtttccaattgagaatctaaaccaagagaagtgagacaaaccatctaatatctgtatcatgctattaataggctgtgatgttgagtttctcacttactctttctgaggtccagggtccttatatgaagagattcatatatatgaagagattcgtctagagcagtggttgtcaaagtgtggtctgggggggcctcaagagcctttcaagggtattctaggtcaaagctgtttttataacactaagacatcatttcactatttatagcttttccttttttttatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtgatattgtaataggctgaatgcaaaagcagatacaagattccagctttcgtctgtcatcagacattgaagagatttggagaaatgtaaagcagcagtactcttctcactaatttttgttgtggttagttagaaaaatggttatttttagtgggttttaatatgtgaaaaaaataaaattagctatttgccaaaaatgtttttatgtgtttatatatacttggttcttgttacttgcaaatgattaataaaaattttaagaaatttc

SEQ ID NO: 161567 - DNA, 1552 bp, Homo sapiens
  Payload ID: 11541
  Gene Symbol: NUDT16
  Gene Name: nudix (nucleoside diphosphate linked moiety X)-type motif 16
  Uniprot ID: Q96DE0
  ENST ID: ENST00000502852
  CDS Start-End: 21-704
cagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgggaccagcctgggactctgtccctttcccaatttcctcttctcccaaagctttctctcccccaagaaagcatccctggagaaaagtctttgcccctctgaccttgccctctccccagctttcttggtggagttgggatcgtgatcatctatactctgaattagtactgccaacctgggctttctgtaaaggtctttcccaccctttaccaggagagatcctttctagaacacactcatccatgtctctctgctgttccctattgacagtgtgatagattatcacattatctaggtgtggcaacctaggttttattcttggggtttgcttttcttgtgtaggagatgtggccctgatatttcaggcagggctagtagatagattatgtatgaaggtggttctcaaaatttggcaggtagcagaatcatcggggcgtcttattaaaatagcgatttctctcagcattcctgcattggtggtggggcggggggagaggaaacctgagaatttgtagttttcaaaagttcccaaataatgctgatgcaaataatctgaggaccacattttgacaaccactggtgaaagggtatgaatacatctttgaggcagtagccactagaggtttagaagcagatgtgggaaagattaattgatagagctagataatatgttttgggtcattttcctgcagaaggttgggccactaggctttagtgaggtgtgagccttgggcctggttctgctggagtattaaggggtgaggcctgatctgctggagaaaggatggagttaagggaatgagccacctggggccctagtgtctcctgtctccttccttttacaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagaga

SEQ ID NO: 161568 - DNA, 6108 bp, Homo sapiens
  Payload ID: 11541
  Gene Symbol: NUDT16
  Gene Name: nudix (nucleoside diphosphate linked moiety X)-type motif 16
  Uniprot ID: Q96DE0
  ENST ID: ENST00000521288
  CDS Start-End: 32-619
cttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgttggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcagagaagtatagaagagccaggtaggggattttatttacaacatgttcaattctgaggaagaggagtatgggcagggcagaggaaaaaggaaaaatgggaaacccccatggacttagggcccccacaaagagaaaccatgtgccttctccccacttcccttctggcttgggcaaatgaggctccctttaggggtagaggtactctacaggggctatgttccctttaggggtagaggtagtctacaggggccagctgggcagagatgaaatcttgcaaaggaacccttcttacactcgaaaagcaagaatagcaaagggactttgggaaggacataaaacaagaaaaggaagctcctcaccaacagctcccagatggagggagtttgtgtgtctagcattttcaccaaagtgctgctcatcctgatgcacagatgcagattggagctgctgcctgtgccctcaccatgggtatgtacccaccacaggcattcccaggtgatgcgggggcagaggattccctctttccactcaggataacaacccctcgatggggttttcaacaagtatagaaagctcctggactcagccaagaccctcacctacagtcccagtcctcccaccttcttcaggtctctagaagacagaactgatgggtttacaacatcctattatccagcactagtcctaggttgtggatgtagggaaaggccaggtaaacaaggaagggagaacaggtgaatgaccccaattgtttgaaaccaaaagagcagaattgcccctaattgatttaagtaaacagcaagtaacataggtctgttaaatagaagaggatgtgagcaccagatgcacgtgataaagaccatgctctggaagattcattccaaggagtagaagtggtatttactcagggcatttaaggagagcagggactctgaaatgaggtgagagaaaagataagacatgcaggaacagctggcaacaccaagaaagaatttaaggagagggatctctctgttagagaacttaacattaccctaggaacagcaagagcatcatcagccccaggaaaatctacctctgatatggagaccaggcttaagaaaatcccctagaacccagagaaaaagtgcaaaacaaggaaaatggccaaagagaatatcatagatacagagatcagacaatgagaatccagagtcttgttaagtgatagaaggaaaatactaacagaacacatgtaacaggaacaacattttagaggaaacaggacaaaaacttccctaaactcaagatactacaccagaagtgggcagtactcactatgttcaggggaacaaaaagataaaaactaaaaagcatcagactgttttttgtgtgaaggaaatttgtaaggtaggagaattaggtcacttactacagcacaaattgcatgtctatctaaattgacgtttaagtgcaaaagcatggatattactcatgcagttttactggaaaaccatacagatgtttttcaggaatgtacagaatgaatcaaaggaaataactgatcgacaggaaaactgtaggaaatttgtgggctggctgtgaggcagtggctcctattatgtacaattttagtgctaagtactgtgttaatgatggctatcaaacaatatgttaacatctgaaaggaaatatgtatattgagcataataaatattttataaataacaataaatcatttgattttatgcta

SEQ ID NO: 161569 - DNA, 5943 bp, Homo sapiens
  Payload ID: 11541
  Gene Symbol: NUDT16
  Gene Name: nudix (nucleoside diphosphate linked moiety X)-type motif 16
  Uniprot ID: Q96DE0
  ENST ID: ENST00000537561
  CDS Start-End: 76-555
aggcgcctaggttcctccccttatccctgcagggattgggccttgcagcaccgcccaggctcggattggtccgagatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgttggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcagagaagtatagaagagccaggtaggggattttatttacaacatgttcaattctgaggaagaggagtatgggcagggcagaggaaaaaggaaaaatgggaaacccccatggacttagggcccccacaaagagaaaccatgtgccttctccccacttcccttctggcttgggcaaatgaggctccctttaggggtagaggtactctacaggggctatgttccctttaggggtagaggtagtctacaggggccagctgggcagagatgaaatcttgcaaaggaacccttcttacactcgaaaagcaagaatagcaaagggactttgggaaggacataaaacaagaaaaggaagctcctcaccaacagctcccagatggagggagtttgtgtgtctagcattttcaccaaagtgctgctcatcctgatgcacagatgcagattggagctgctgcctgtgccctcaccatgggtatgtacccaccacaggcattcccaggtgatgcgggggcagaggattccctctttccactcaggataacaacccctcgatggggttttcaacaagtatagaaagctcctggactcagccaagaccctcacctacagtcccagtcctcccaccttcttcaggtctctagaagacagaactgatgggtttacaacatcctattatccagcactagtcctaggttgtggatgtagggaaaggccaggtaaacaaggaagggagaacaggtgaatgaccccaattgtttgaaaccaaaagagcagaattgcccctaattgatttaagtaaacagcaagtaacataggtctgttaaatagaagaggatgtgagcaccagatgcacgtgataaagaccatgctctggaagattcattccaaggagtagaagtggtatttactcagggcatttaaggagagcagggactctgaaatgaggtgagagaaaagataagacatgcaggaacagctggcaacaccaagaaagaatttaaggagagggatctctctgttagagaacttaacattaccctaggaacagcaagagcatcatcagccccaggaaaatctacctctgatatggagaccaggcttaagaaaatcccctagaacccagagaaaaagtgcaaaacaaggaaaatggccaaagagaatatcatagatacagagatcagacaatgagaatccagagtcttgttaagtgatagaaggaaaatactaacagaacacatgtaacaggaacaacattttagaggaaacaggacaaaaacttccctaaactcaagatactacaccagaagtgggcagtactcactatgttcaggggaacaaaaagataaaaactaaaaagcatcagactgttttttgtgtgaaggaaatttgtaaggtaggagaattaggtcacttactacagcacaaattgcatgtctatctaaattgacgtttaagtgcaaaagcatggatattactcatgcagttttactggaaaaccatacagatgtttttcaggaatgtacagaatgaatcaaaggaaataactgatcgacaggaaaactgtaggaaatttgtgggctggctgtgaggcagtggctcctattatgtacaattttagtgctaagtactgtgttaatgatggctatcaaacaatatgttaacatctgaaaggaaatatgtatattgagcataataaatattttataaataacaataaatcatttgattttatgcta

SEQ ID NO: 161570 - DNA, 1349 bp, Homo sapiens
  Payload ID: 11542
  Gene Symbol: NUDT16L1
  Gene Name: nudix (nucleoside diphosphate linked moiety X)-type motif 16-like 1
  Uniprot ID: Q9BRJ7
  ENST ID: ENST00000304301
  CDS Start-End: 34-669
agtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctca

SEQ ID NO: 161571 - DNA, 2040 bp, Homo sapiens
  Payload ID: 11542
  Gene Symbol: NUDT16L1
  Gene Name: nudix (nucleoside diphosphate linked moiety X)-type motif 16-like 1
  Uniprot ID: Q9BRJ7
  ENST ID: ENST00000405142
  CDS Start-End: 10-753
agtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtgggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcataccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgttt

SEQ ID NO: 161572 - DNA, 709 bp, Homo sapiens
  Payload ID: 11542
  Gene Symbol: NUDT16L1
  Gene Name: nudix (nucleoside diphosphate linked moiety X)-type motif 16-like 1
  ENST ID: ENST00000590460
  CDS Start-End: 1-596
tcagccgggtggaggcgatgcgcctagggccgggctggagccactcgtgccacgccatgctgtacgccgccaaccctgggcagctcttcggccgcatccccatgcgcttctcggtgctgatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtg

SEQ ID NO: 161573 - DNA, 922 bp, Homo sapiens
  Payload ID: 11542
  Gene Symbol: NUDT16L1
  Gene Name: nudix (nucleoside diphosphate linked moiety X)-type motif 16-like 1
  ENST ID: ENST00000586252
  CDS Start-End: 25-540
ggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggag

SEQ ID NO: 161574 - DNA, 1406 bp, Homo sapiens
  Payload ID: 11542
  Gene Symbol: NUDT16L1
  Gene Name: nudix (nucleoside diphosphate linked moiety X)-type motif 16-like 1
  ENST ID: ENST00000586536
  CDS Start-End: 21-599
gggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctca

SEQ ID NO: 161575 - DNA, 1473 bp, Homo sapiens
  Payload ID: 11543
  Gene Symbol: NUDT17
  Gene Name: nudix (nucleoside diphosphate linked moiety X)-type motif 17
  Uniprot ID: P0C025
  ENST ID: ENST00000334513
  CDS Start-End: 13-999
cagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggtgggcacgtggaacttgaggaggagctgctggacggagggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggaaaggtgcagaatgagccaggcctaactacagggccatgagcctctagaagcttaggggggaataagaaacactgtgaacttagatatataaatagagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctgaa

SEQ ID NO: 161576 - DNA, 1754 bp, Homo sapiens
  Payload ID: 11544
  Gene Symbol: NUDT18
  Gene Name: nudix (nucleoside diphosphate linked moiety X)-type motif 18
  ENST ID: ENST00000613958
  CDS Start-End: 120-521
ctcgtgagctcccggcccgctgccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtatggcccacctggaggcagtgtgaacagggccagttgacacctttcccccagctcctcggtgaggtgagcccctctacagccagtcctgttatggctggcacagcctggcatgggcagattccagcctttgggctgggggcctctctcctgggtcagggatgtctgttgactctgccagagctgcacttctctccacacagaccctccctgccccatcccccacatctcccccaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctatggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtgggggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctcttcccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcacctt

SEQ ID NO: 161577 - DNA, 1497 bp, Homo sapiens
  Payload ID: 11544
  Gene Symbol: NUDT18
  Gene Name: nudix (nucleoside diphosphate linked moiety X)-type motif 18
  Uniprot ID: Q6ZVK8
  ENST ID: ENST00000611621
  CDS Start-End: 98-1069
ccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctatggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtgggggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctcttcccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcaccttgc

SEQ ID NO: 161578 - DNA, 2967 bp, Homo sapiens
  Payload ID: 11545
  Gene Symbol: NUDT19
  Gene Name: nudix (nucleoside diphosphate linked moiety X)-type motif 19
  Uniprot ID: A8MXV4
  ENST ID: ENST00000397061
  CDS Start-End: 1-1128
atgagcagctccctgcggccgggccccagccgctggcggcgggcggccagcatcgtcctggcggctggctggtcgcgcccggagaccgccaccccgccgtcgcgcccgccgccggccgagggcttccggctgctgctgctgcagcgctccccgcaccaaggcttcatgccgggcgcgcacgtcttctccggcggagtgctggatgcggccgaccgctcggcggactggctgggcctcttcgcgccgcaccacgggccgccgcgcttcggcctgggcccggcgccattcagccgcaccgctttcccgtcgctgcccgacaccgatgaccacaagaccgacaacactgggacgctgcctgaggacgtagccttccgcatctgcgccgtgcgggaggcctttgaggaggcgggcgtgctgctgctgcggcccaggacttccccaccaggcccagcacccgggcctggcctcgccctggagccaccgccgggcctggcctcctggcgcgaccgcgtgcgccaggacccgcgccacttcctgcggctgtgcgcccacctcgactgcacacccgacatctgggcgctgcacaactggagcgcctggctcacccctttcttgcggggcaccactcgccgctttgacacggccttcttcctgtgctgcctgcgcgagccgccgcccgtctaccccgacttggcggaggtggtgggctaccagtggtcatctccatcagaggcaactgaaagtttcttatcaaaagaaatttggttgccacccccacagttctacgaagtgagaagacttgcaaactttgcctctctctctgacttgcacaaattttgtttgggtcgtgcattagaaggactggaaaggtggctgccgatcatcttgttaactgctgatgggatggtccatcttttaccaggtgatgagctatatttagaagattcagactttttggaaaatcttatgtctactgaaaaaaagactgaggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaggatggtctcaatctcttgacctcgtgatacgcccgccttggcctcccaaagtgctgggattacaggtgtgggccaccacacccagcctttttttttttttttttttttttttttgagacagagtgtctcactcttgcccagaacccaggctggagtgcagtggcccaatctcggctcactgcaacctccacctcccaggttccagcgattctcatgcctcagcctcctgagtagctgggactataggcatgcaccaccatgccccactaaattttgtatttttagtagaaacagagtttcaccatgttggccaggctggtctcgatctcctgacctcatgatctgcccgccttggcctcccaaagtgtgggattacaggcgtgagccactgtgcccagcatggtgtttcttatatcaggtgttttagggagctcgcttgcttattccattctttaatccttacagtgtgccacacgtataaagtttataacgtattaatgatctcattacccaaaaccagaacataatttcacaagggttcctacttctgtattgttttattatctcaaaaatttaaataacatgttctgctgtttattgttcttgttatccactgtattagcaccttccctgatgtgctttggaggttgatcaatgaatttctgagactttctgctggaattactttaagggtgtcttattagatgatgaaaagttggctgagacacccttcaagtgaccatgtcattgttttcttgctatgtctttagcttaatgattaagatacaattctttttaaaatcaaatggtattagttattatgtttcccaaattagaaatcgattttagttaacattttattttattttattctattttatttatttttgagacagagtctcgctctgttgcccaggctggagtacaatggcgcaatctcagctcactccaatctccgcctcccaggttcaagcgatttttctgcctcagcctcccgagtagctgggattacaggcacccactaccatgcccagctaatctttgtatttttagtagagacggggtttcaccatgttggccagtccggtctcgaacttctgacctgaggtgatctgcccaccttggcctcacaaagtgctgagattacaggcttgagccaccacgcctggcctagttagcattttaaagaaacacaaagccataacaaaaaccatcattgtttgtattccacactgttaatgaatgtaaagaggttagaaatgtagtgtttgattaatgatgtttatttttactgtatttaatatgagtaatttttcatcatctttcaagaggaataatgtttattgattaaaggtgagaaatgatagttaagacaccaattccatgtccagatctttgactgtatcatgcattgtacaattgatttcatattttatgaaatgccttaattttcctactataacataaagacaatgatgaataaagtttatgtgtatgattaaatcca

SEQ ID NO: 161579 - DNA, 960 bp, Homo sapiens
  Payload ID: 11546
  Gene Symbol: NUDT2
  Gene Name: nudix (nucleoside diphosphate linked moiety X)-type motif 2
  Uniprot ID: P50583
  ENST ID: ENST00000346365
  CDS Start-End: 246-689
ctattgatgggcccaagcgtaaccaggctcttctgattggccggtgtacttcagtttccgtccaaggtccgcctcctacctccttctgcttcggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttct

SEQ ID NO: 161580 - DNA, 1002 bp, Homo sapiens
  Payload ID: 11546
  Gene Symbol: NUDT2
  Gene Name: nudix (nucleoside diphosphate linked moiety X)-type motif 2
  Uniprot ID: P50583
  ENST ID: ENST00000379155
  CDS Start-End: 288-731
ctattgatgggcccaagcgtaaccaggctcttctgattggccggtgtacttcagtttccgtccaaggtccgcctcctacctccttctgcttcggttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttct

SEQ ID NO: 161581 - DNA, 1075 bp, Homo sapiens
  Payload ID: 11546
  Gene Symbol: NUDT2
  Gene Name: nudix (nucleoside diphosphate linked moiety X)-type motif 2
  Uniprot ID: P50583
  ENST ID: ENST00000379158
  CDS Start-End: 359-802
ctattgatgggcccaagcgtaaccaggctcttctgattggccggtgtacttcagtttccgtccaaggtccgcctcctacctccttctgcttcggggagggcatgggatcagctacctgtttctgcctcaaccacggaccaataatatgagatctttgttcaccagttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttctaa

SEQ ID NO: 161582 - DNA, 825 bp, Homo sapiens
  Payload ID: 11546
  Gene Symbol: NUDT2
  Gene Name: nudix (nucleoside diphosphate linked moiety X)-type motif 2
  Uniprot ID: P50583
  ENST ID: ENST00000618590
  CDS Start-End: 111-554
ctattgatgggcccaagcgtaaccaggctcttctgattggccggtgtacttcagtttccgtccaaggtccgcctcctacctccttctgcttcggtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttct

SEQ ID NO: 161583 - DNA, 4436 bp, Homo sapiens
  Payload ID: 11547
  Gene Symbol: NUDT21
  Gene Name: nudix (nucleoside diphosphate linked moiety X)-type motif 21
  Uniprot ID: O43809
  ENST ID: ENST00000300291
  CDS Start-End: 174-857
cctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaagagaa

SEQ ID NO: 161584 - DNA, 581 bp, Homo sapiens
  Payload ID: 11547
  Gene Symbol: NUDT21
  Gene Name: nudix (nucleoside diphosphate linked moiety X)-type motif 21
  ENST ID: ENST00000566340
  CDS Start-End: 133-581
ctgaagcctgcaagcattagtgtgtcgctcccattcaccgactttccgaggtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccc

SEQ ID NO: 161585 - DNA, 385 bp, Homo sapiens
  Payload ID: 11547
  Gene Symbol: NUDT21
  Gene Name: nudix (nucleoside diphosphate linked moiety X)-type motif 21
  ENST ID: ENST00000568822
  CDS Start-End: 173-385
atttcatcttcacatctccttactgatatattggagctggctcttgcaacagagatgtgtaatggctatccttaattctttctaactcaggtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaa

SEQ ID NO: 161586 - DNA, 1094 bp, Homo sapiens
  Payload ID: 11548
  Gene Symbol: NUDT22
  Gene Name: nudix (nucleoside diphosphate linked moiety X)-type motif 22
  Uniprot ID: Q9BRQ3
  ENST ID: ENST00000279206
  CDS Start-End: 157-1068
ggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcagagattgctcgagacggagatgtgggctgaactctgcccctcggccaaaggcgccatcatcctctacaaccgggttcagggaagtcccactggagcggccctagggtccccagccctactcccgccgctctgaaaataataaacgactttattcttgga

SEQ ID NO: 161587 - DNA, 876 bp, Homo sapiens
  Payload ID: 11548
  Gene Symbol: NUDT22
  Gene Name: nudix (nucleoside diphosphate linked moiety X)-type motif 22
  ENST ID: ENST00000428347
  CDS Start-End: 45-876
acaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcagctggacctctggttgtctgtcagggaaaggacaccagactcaggatcactaactctcttacactgtgccacatcagaccctcaaggccagcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacg

SEQ ID NO: 161588 - DNA, 986 bp, Homo sapiens
  Payload ID: 11548
  Gene Symbol: NUDT22
  Gene Name: nudix (nucleoside diphosphate linked moiety X)-type motif 22
  Uniprot ID: Q9BRQ3
  ENST ID: ENST00000441250
  CDS Start-End: 157-969
ggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcagagattgctcgagacggagatgtgggctgaactctgcccctcggccaaaggcgccatcatcctctacaaccgggttcagggaagtcccactggagcggccctagggtccccagccctactcccgccgctctgaaaataataaacgacttt

SEQ ID NO: 161589 - DNA, 1071 bp, Homo sapiens
  Payload ID: 11548
  Gene Symbol: NUDT22
  Gene Name: nudix (nucleoside diphosphate linked moiety X)-type motif 22
  ENST ID: ENST00000535000
  CDS Start-End: 364-861
ggcggctggtgagcgcccgctggaggctggagcttccgggccctggaaaggggtccccgcgcgccccgggtcggaggcagacccctgggtttgggggacatgggcatttggggcgcctgaacccaagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgcagcctgacttctgagcaggtgaggaagcactacctgagtgggggacccgaggcccacgagtctacaggaatcttctttgtggagacacagaacgtgcagagattgctcgagacggagatgtgggctgaactctgcccctcggccaaaggcgccatcatcctctacaaccgggttcagggaagtcccactggagcggccctagggtccccagccctactcccgcc

SEQ ID NO: 161590 - DNA, 659 bp, Homo sapiens
  Payload ID: 11548
  Gene Symbol: NUDT22
  Gene Name: nudix (nucleoside diphosphate linked moiety X)-type motif 22
  ENST ID: ENST00000543358
  CDS Start-End: 49-546
aggggcggagcctgagggacccggcggctgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgcagcctgacttctgagcaggtgaggaagcactacctgagtgggggacccgaggcccacgagtctacaggaatcttctttgtggagacacagagaggctccggggcggaagcagctccgtaagatatac

SEQ ID NO: 161591 - DNA, 643 bp, Homo sapiens
  Payload ID: 11548
  Gene Symbol: NUDT22
  Gene Name: nudix (nucleoside diphosphate linked moiety X)-type motif 22
  ENST ID: ENST00000534929
  CDS Start-End: 1-171
tctacaggaatcttctttgtggagacacagaacgtgcagagattgctcgagacggagatgtgggctgaactctgcccctcggccaaaggcgccatcatcctctacaaccgggttcagggaagtcccactggagcggccctagggtccccagccctactcccgccgctctgaaaataataaacgactttattcttggattccgttggcatctgctatttctgtaacagagaggagcaatgggccctgagtgtagaggctccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgc

SEQ ID NO: 161592 - DNA, 746 bp, Homo sapiens
  Payload ID: 11548
  Gene Symbol: NUDT22
  Gene Name: nudix (nucleoside diphosphate linked moiety X)-type motif 22
  ENST ID: ENST00000539325
  CDS Start-End: 376-746
caaagcctcaggaagtgagcgctgggtgggagtatacggctcattaagttcaccacccccaagtccctgctgcagagagggaaactaaggcccagcaggccagacttgcccaaggtcacacggtcagccaggagcgcagggaggccgagccccgcaccccagatcgctggtgcgccccgcagggtggtccgggaggcagggccgacgtgccgacggaccgggcggaagcgtcggggcggcggggacaaacctccaggatcctcgaccgcggcggacccgccaatgaaaagccgcgtggaaagggggcgggcacttccgcttcggggaaggggcggagcctgagggacccggcggctgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtggg

SEQ ID NO: 161593 - DNA, 9905 bp, Homo sapiens
  Payload ID: 11549
  Gene Symbol: NUDT3
  Gene Name: nudix (nucleoside diphosphate linked moiety X)-type motif 3
  Uniprot ID: O95989
  ENST ID: ENST00000607016
  CDS Start-End: 313-831
gccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctcaaaaaaaaaaaaaaaaaatttttttttttttttttgctatatactcttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcactccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggtggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacaca

SEQ ID NO: 161594 - DNA, 9753 bp, Homo sapiens
  Payload ID: 11550
  Gene Symbol: NUDT4
  Gene Name: nudix (nucleoside diphosphate linked moiety X)-type motif 4
  Uniprot ID: Q9NZJ9
  ENST ID: ENST00000337179
  CDS Start-End: 441-986
gcatgtgggcttcatttaaacagagcagagggggcggcgcgcggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttctagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcaggaggctgaggcaggagaatcgcttgaacgcgggaggcagaacctgcagtgagccaagatcatgccacagcactccagcctaaactacagagctagaaagtggctagagcagccaaaaaaaaaaaaaaaaaaaaaaaaaaaaaaggttcctgaaccattcaacagaaaaatgaggcctattcctatcatttcctcgatccaatttagttccacttaggtcactgtgtttataatgtcttttaggacagatttccttccccattctccatcaaacaaccatagcacctgtgacttttatctgttggtttgtatttaatcttatttttaagtgcttctttgaaattgttttacaagtacattcttggtctagagtaaggttctatatagttggccctccatatccatgggttccacttccgtggattcaaacaaccagacaaaatattccaaaaaacattgtgtctgtagtcaacatgtatatttttgtcattattccttaaacaatagtgtaactatttacatagcacttacattataataggtattataagtaatctaaatattaacataagcgggaggatttgtgtagattgtatgcatatacaacatcattttattccagagacttgagcatctgcgaatttggatatccaaaggaagtcctagaaccagttcccgacaaataccaagagatgactttactttagacctaagatcttgctagacagcctttgagaggatgaaggataactagagcagaagcaaatcgcagcgaagtagactacaacaatcaagtcaaaaaacataaagctcctatcaacacctcaagattttagaaaagcctcttaacgggcaattttcttttaaataaagactgggtcccactatgttagccaggctggtcacaaactcctggactcaagtgatcctcctgccttggcctcctaaagtgctgggattacaggcatgagccactgtgcccggcctgggcagtcgattttcaggaagccacttaatgttcagattcttttcttctctcccaggactttgcagatgctgctgttccctctgcctggagatgttcatctggcctgaatccaaaagtctgtccaagttacttctcttttccatgacagagttacaactatttgtctgtcccccttccccattagagtatatggtccccaaaggaaagccccatgccattcactcaccacctaatcatccccaacaactagtgggcaaacatgaaacacttttgttgaataatgtgtttcctttagcccagggattacaaagtcaaaggcttacaagggggaaggactagcaggtgtgctcggaggggactctagccaactggagagtaactggtgagaagacaatgacatgctcttagggtgtctgctactcagatcctctcagttaagtcccgtgcacaaaggtgggtcaggtctactgttgccagatcttcagatcattcaaaagttacccgaattctggattttcatgcaaatctcccaatttttaaaaatgttggcatcaaattcagaatgttttaaccagccacactgtgtgggccagggaaaacaggcccaaaggccaggtgaagctgcagttttcaactgctgccttggcctctcccagagccccttaagtcctaagaaggctcagtcaacacactggcactcgtttcatcccactggttgagaaagcaagtcttagcaaagtaatgggggagtcttaccaaaactgcaaaggaaaaaaatatgataccatgaaattagaaattcactgcatttgaaatgaaaatgacttatttctgtacttctataactcacaaatttagcagacatcatttagacatttttgtagtgcaacagatttaaatctggaatttcatggtttgtaaatcactatgtgatactagctataaccatgagcaatattacgggcagtaaatgttgatttctatttcgtttcttgaa

SEQ ID NO: 161595 - DNA, 4839 bp, Homo sapiens
  Payload ID: 11550
  Gene Symbol: NUDT4
  Gene Name: nudix (nucleoside diphosphate linked moiety X)-type motif 4
  Uniprot ID: Q9NZJ9
  ENST ID: ENST00000415493
  CDS Start-End: 428-970
atttaaacagagcagagggggcggcgcgcggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaa

SEQ ID NO: 161596 - DNA, 1419 bp, Homo sapiens
  Payload ID: 11550
  Gene Symbol: NUDT4
  Gene Name: nudix (nucleoside diphosphate linked moiety X)-type motif 4
  Uniprot ID: Q9NZJ9
  ENST ID: ENST00000547014
  CDS Start-End: 271-660
acttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaa

SEQ ID NO: 161597 - DNA, 531 bp, Homo sapiens
  Payload ID: 11550
  Gene Symbol: NUDT4
  Gene Name: nudix (nucleoside diphosphate linked moiety X)-type motif 4
  ENST ID: ENST00000550056
  CDS Start-End: 246-531
ctttcctccctcactcctttcctccctcacttcttccttcctttctctgggctgatagatgagacaaagggggctcgcccagccccagtttctccatctgggcactcgagaaggcgcctggtccccgggaaggtcccgggccgcctacgtggcgctcccatctggctgttcctgtactgaagttctcagtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgtt

SEQ ID NO: 161598 - DNA, 569 bp, Homo sapiens
  Payload ID: 11550
  Gene Symbol: NUDT4
  Gene Name: nudix (nucleoside diphosphate linked moiety X)-type motif 4
  ENST ID: ENST00000546925
  CDS Start-End: 233-569
ctcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggtatctaggaaaagacaaaataactcttcagcagtgccaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgcct

SEQ ID NO: 161599 - DNA, 3607 bp, Homo sapiens
  Payload ID: 11550
  Gene Symbol: NUDT4
  Gene Name: nudix (nucleoside diphosphate linked moiety X)-type motif 4
  ENST ID: ENST00000549992
  CDS Start-End: 299-685
ctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaa

SEQ ID NO: 161600 - DNA, 765 bp, Homo sapiens
  Payload ID: 11550
  Gene Symbol: NUDT4
  Gene Name: nudix (nucleoside diphosphate linked moiety X)-type motif 4
  ENST ID: ENST00000548662
  CDS Start-End: 174-560
acttcttccttcctttctctgggctgatagatgagacaaagggggctcgcccagccccagtttctccatctgggcactcgagaaggcgcctggtccccgggaaggtcccgggccgcgtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtgg

SEQ ID NO: 161601 - DNA, 1258 bp, Homo sapiens
  Payload ID: 11551
  Gene Symbol: NUDT5
  Gene Name: nudix (nucleoside diphosphate linked moiety X)-type motif 5
  ENST ID: ENST00000378927
  CDS Start-End: 95-637
tgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggaggtatgttctgcaactcctggtggccgagcgtgtatgacttagtgtagtggtgatggctgcagacattttgggttgttttggtaggctcttgacgttagctttgttttcacttgcactttgtctgtttagagtttgtggaagtcatttctttacccaagaatgacctgctgcagagacttgatggtaagcattctccagaccgccacccagtttctccagttctccccgtccccatcccagcaaactgggtactaaatataactccatttctttatcttttttgtatcactaaagtcaaatgcctagcaacttgtaaaactgcaggtgaccactactaattttcctttctgggtggcacagagtttgaaaataagagcaaagcattctgggtcaagtgcaaacttttggtagaggctttttctcctacagaatggcccagatgacattcctgctgagtagccaaaacgattctacactttaaaccttcagtccatagcaatgcaaaggtgtgggtagataagctgttagcttttcctcaagtatgctagtatgagggatggtcctttgtggaggctgtatgttcaaggagaaattgatgatgctccttcaacaaatacttgaggtatttcctgtatactccgtgtgatatgcttttcacataataaacc

SEQ ID NO: 161602 - DNA, 919 bp, Homo sapiens
  Payload ID: 11551
  Gene Symbol: NUDT5
  Gene Name: nudix (nucleoside diphosphate linked moiety X)-type motif 5
  ENST ID: ENST00000378937
  CDS Start-End: 95-793
tgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaagaaataaagagaaaacaacaacattgctaattttgagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaaca

SEQ ID NO: 161603 - DNA, 1126 bp, Homo sapiens
  Payload ID: 11551
  Gene Symbol: NUDT5
  Gene Name: nudix (nucleoside diphosphate linked moiety X)-type motif 5
  ENST ID: ENST00000378940
  CDS Start-End: 142-702
gaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgagactttgtaaacagtaagcttatggggagaaaagtcctttgataaaaccacgagaggagatactgtatggagacatgaggagatactgtgtggagacgaggagatactgtatggagacataccatgggcccttcaaggagcacctctgtatgggctggcaaatccctttcactcatctagaaagaagcagacacttgtcatcatgggaatattttattgggtataagtgttttaggtaattgataactgatttttctactgtttttaagtgattacttcaaatgtgatttgaagcattgtttggcctgaagctttaagaccagtttcttaagcttttccctgagtttcagcagcttacggtttcagtgaataagcagagcgcctggttttgaattgtctgttgtttgtttgaaaatctgaatgtgtctttcaaa

SEQ ID NO: 161604 - DNA, 410 bp, Homo sapiens
  Payload ID: 11551
  Gene Symbol: NUDT5
  Gene Name: nudix (nucleoside diphosphate linked moiety X)-type motif 5
  ENST ID: ENST00000444732
  CDS Start-End: 118-410
gcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtaggagtgcaaacctattccaaccctttagaaaggaagttagcacttgtgatcgtgtcgcggtcatccccgtgctgcagagaacacttcactatgagtgtatcgttctggt

SEQ ID NO: 161605 - DNA, 3433 bp, Homo sapiens
  Payload ID: 11551
  Gene Symbol: NUDT5
  Gene Name: nudix (nucleoside diphosphate linked moiety X)-type motif 5
  Uniprot ID: Q9UKK9
  ENST ID: ENST00000491614
  CDS Start-End: 397-1056
gcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtctttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgtttacactc

SEQ ID NO: 161606 - DNA, 622 bp, Homo sapiens
  Payload ID: 11551
  Gene Symbol: NUDT5
  Gene Name: nudix (nucleoside diphosphate linked moiety X)-type motif 5
  ENST ID: ENST00000476462
  CDS Start-End: 1-412
aacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggaggtatgttctgcaactcctggtggccgagcgtgtatgacttagtgtagtggtgatggctgcagacattttgggttgttttggtaggctcttgacgttagctttgttttcacttgcactttgtctgtttagagtttgtggaagtcatttctttacccaagaatgacctgctgcagagacttgatgctctggtagctgaagaacatctcacagtggacgccagggtctattcctacgctctagcactgaaacatgcaaat

SEQ ID NO: 161607 - DNA, 1201 bp, Homo sapiens
  Payload ID: 11551
  Gene Symbol: NUDT5
  Gene Name: nudix (nucleoside diphosphate linked moiety X)-type motif 5
  Uniprot ID: Q9UKK9
  ENST ID: ENST00000537776
  CDS Start-End: 417-1076
ggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaac

SEQ ID NO: 161608 - DNA, 1169 bp, Homo sapiens
  Payload ID: 11552
  Gene Symbol: NUDT6
  Gene Name: nudix (nucleoside diphosphate linked moiety X)-type motif 6
  Uniprot ID: P53370
  ENST ID: ENST00000304430
  CDS Start-End: 35-985
catttgggcaacggacgaattaagcggcgtggagatgcggcagccactgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcaggctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaaga

SEQ ID NO: 161609 - DNA, 1065 bp, Homo sapiens
  Payload ID: 11552
  Gene Symbol: NUDT6
  Gene Name: nudix (nucleoside diphosphate linked moiety X)-type motif 6
  Uniprot ID: P53370
  ENST ID: ENST00000339154
  CDS Start-End: 438-881
agcagtctttgaaacagctgtaacggcatctgtgaaagaagataggttccaggaacggaactgccacttagattgtaaattcctgaaaaacaggacgtttttgcatctcctcccggcttccccatccctaaaccaacgtctgttgaattaaactaccaaacaaaataactgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaaga

SEQ ID NO: 161610 - DNA, 1620 bp, Homo sapiens
  Payload ID: 11552
  Gene Symbol: NUDT6
  Gene Name: nudix (nucleoside diphosphate linked moiety X)-type motif 6
  ENST ID: ENST00000512116
  CDS Start-End: 11-325
cggcgtggagatgcggcagccactgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcagggcaagtgcgcctgggacgaagggctcccggggctccagagcttttctaatgaaataaccgcggcccccactccctagtcgctctgtgcaccactgtcgagcccagagggaaagggagaaggcacgcgtgacctggacctgttttctggagcattcgtgcttagaccttttgctgggaggtctctaaggcggttgggtgaaatggtgaagatcccggactttgggatctgcaaccctggttgctggtccactttctactgtgcgacattcggaaattgccgtaaaccaccatttcctcttccacagaccccggtgataagaactcctggaattactgagagttaatttggataatgcacataaagtgcacagcacagtgcctgccacgtatttaaagctcagtagatctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaagatcattgctctaggtaagcttcactgggtaacagcagatgcaatataaaagggagaatatacattttaca

SEQ ID NO: 161611 - DNA, 1391 bp, Homo sapiens
  Payload ID: 11552
  Gene Symbol: NUDT6
  Gene Name: nudix (nucleoside diphosphate linked moiety X)-type motif 6
  ENST ID: ENST00000503370
  CDS Start-End: 3-317
agatgcggcagccactgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcagggcaagtgcgcctgggacgaagggctcccggggctccagagcttttctaatgaaataaccgcggcccccactccctagtcgctctgtgcaccactgtcgagcccagagggaaagggagaaggcacgcgtgacctggacctgttttctggagcattcgtgcttagaccttttgctgggaggtctctaaggcggttgggtgaaatggtgaagatcccggactttgggatctgcaaccctggttgctggtccactttctactgtgcgacattcggaaattgccgtaaaccaccatttcctcttccacagaccccgctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaagagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaa

SEQ ID NO: 161612 - DNA, 739 bp, Homo sapiens
  Payload ID: 11552
  Gene Symbol: NUDT6
  Gene Name: nudix (nucleoside diphosphate linked moiety X)-type motif 6
  ENST ID: ENST00000510735
  CDS Start-End: 1-152
gcgatctgcagggcgagctggacagattcgggggcatctcggtgcgcctggcgcggctcgatgcgctggaccgcctggacgctgccgccttccagaagggcttgcaggttgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtga

SEQ ID NO: 161613 - DNA, 678 bp, Homo sapiens
  Payload ID: 11552
  Gene Symbol: NUDT6
  Gene Name: nudix (nucleoside diphosphate linked moiety X)-type motif 6
  Uniprot ID: P53370
  ENST ID: ENST00000502270
  CDS Start-End: 148-591
ggcatcgtctgtaaagaatgagcccttattagacactgaatctgccagcaccttgatcttggacttcctagcttctagaactgagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgt

SEQ ID NO: 161614 - DNA, 1096 bp, Homo sapiens
  Payload ID: 11553
  Gene Symbol: NUDT7
  Gene Name: nudix (nucleoside diphosphate linked moiety X)-type motif 7
  Uniprot ID: P0C024
  ENST ID: ENST00000268533
  CDS Start-End: 70-786
gctctgcgcaagcgcgaccgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatatataa

SEQ ID NO: 161615 - DNA, 930 bp, Homo sapiens
  Payload ID: 11553
  Gene Symbol: NUDT7
  Gene Name: nudix (nucleoside diphosphate linked moiety X)-type motif 7
  Uniprot ID: P0C024
  ENST ID: ENST00000437314
  CDS Start-End: 65-622
gcgcaagcgcgaccgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatatat

SEQ ID NO: 161616 - DNA, 316 bp, Homo sapiens
  Payload ID: 11553
  Gene Symbol: NUDT7
  Gene Name: nudix (nucleoside diphosphate linked moiety X)-type motif 7
  ENST ID: ENST00000563839
  CDS Start-End: 39-86
ccgaggagtccgcccggaaacaaacattccccagggcaatgtcacgacttggtcttcccgaggagccagtcagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtg

SEQ ID NO: 161617 - DNA, 678 bp, Homo sapiens
  Payload ID: 11553
  Gene Symbol: NUDT7
  Gene Name: nudix (nucleoside diphosphate linked moiety X)-type motif 7
  ENST ID: ENST00000568787
  CDS Start-End: 68-430
tctgcgcaagcgcgaccgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatgtaagggtttcctgagacactcatgagcaccgtccccacccccaggtggatctactgttctcaggattccacattttccaaacataaccccaaagagtactgtacataaagtcaagagaacaggttctcctacagacattgcccctcatgagtcaagtggctatgggcaaccccttttgcctctccggacccctctttccccatccagaaataaaagggttgaactcccatcagtggatttcaaactggatgccatagaaccc

SEQ ID NO: 161618 - DNA, 899 bp, Homo sapiens
  Payload ID: 11553
  Gene Symbol: NUDT7
  Gene Name: nudix (nucleoside diphosphate linked moiety X)-type motif 7
  Uniprot ID: P0C024
  ENST ID: ENST00000564085
  CDS Start-End: 70-582
gctctgcgcaagcgcgaccgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatagatgggggtctcgctatgttgatgaggctggtctcgagctcctggcctcaagtgatcctcccacctcagcctcccaaagtgctgggattacagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagaca

SEQ ID NO: 161619 - DNA, 1073 bp, Homo sapiens
  Payload ID: 11553
  Gene Symbol: NUDT7
  Gene Name: nudix (nucleoside diphosphate linked moiety X)-type motif 7
  ENST ID: ENST00000613075
  CDS Start-End: 92-763
ggccgctcccaagcccagagctgctctgcgcaagcgcgaccgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagccatgtgaagtgcttgctcctcctttaccttccgccatgattgtaagtttcctgaggtctccccagaagccaagcagacgccagcatcatgctccctgtacggcctgcgagactacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatatataa

SEQ ID NO: 161620 - DNA, 809 bp, Homo sapiens
  Payload ID: 11554
  Gene Symbol: NUDT8
  Gene Name: nudix (nucleoside diphosphate linked moiety X)-type motif 8
  Uniprot ID: Q8WV74
  ENST ID: ENST00000301490
  CDS Start-End: 20-442
cggccgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtgagctgggggatatgagggggttgggctgttccagtcctctgtctaccctctctgcctcctgcctgcaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggccagctccactccaggactgaataaaggtctttgacagctcta

SEQ ID NO: 161621 - DNA, 728 bp, Homo sapiens
  Payload ID: 11554
  Gene Symbol: NUDT8
  Gene Name: nudix (nucleoside diphosphate linked moiety X)-type motif 8
  Uniprot ID: Q8WV74
  ENST ID: ENST00000376693
  CDS Start-End: 11-721
aggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggccagctccactccaggactgaataaaggtctttgacagctct

SEQ ID NO: 161622 - DNA, 1701 bp, Homo sapiens
  Payload ID: 11555
  Gene Symbol: NUDT9
  Gene Name: nudix (nucleoside diphosphate linked moiety X)-type motif 9
  Uniprot ID: Q9BW91
  ENST ID: ENST00000302174
  CDS Start-End: 325-1377
ccgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctat

SEQ ID NO: 161623 - DNA, 951 bp, Homo sapiens
  Payload ID: 11555
  Gene Symbol: NUDT9
  Gene Name: nudix (nucleoside diphosphate linked moiety X)-type motif 9
  ENST ID: ENST00000440591
  CDS Start-End: 98-951
agatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataa

SEQ ID NO: 161624 - DNA, 2458 bp, Homo sapiens
  Payload ID: 11555
  Gene Symbol: NUDT9
  Gene Name: nudix (nucleoside diphosphate linked moiety X)-type motif 9
  Uniprot ID: Q9BW91
  ENST ID: ENST00000473942
  CDS Start-End: 123-1025
acgcagagagaaagttacgaggttcgtggccgcggtttccccaggcagctggcgctggaggcttcggcgtcacgtgctgaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataacttctgtttcatctagttcttgtttgtcaatgccttccctcccgctccccatcttctgaggcctgaaggatgttcctgccacatcaaactcctttaggcagagtaccgccactggatgtatagtttaatgtttcatctgatttttctttaaattatttccttcacattttgcttcacatgatcttgttgaagctaattttgaaaatggaaactatgttttcttgactttagaagcattagttttaagaggaaatttcagccactagtcaatagagatcaaaatcagtgaacaagagctgatactctcattttcaaaaattctgaattaaaaaaagtccaggaagttagtaatttaaatcagtatgttcatttcactctagtgaaactactatatgttgtaaattagttaaaaatggatgttcagaaaagaattgaaatcaggacaaaaaattacagatgctagtgaggttgtagagaaaaaggaatgcttatacgctgttagtgggagtgtaaattggtccaaccattgtggaagagagtgtagagagtcctcaaatatttaaagatatttgacccagtaatcccattactaggtatatacccgaaggaatataaattgttctattataaacacatactcacgtgtatgttcattgctgcactattcacaatagcgaagacatgaaatcaacctaaatgttcatcagtgatagactggataaagacaatgtggtatatgtacaccatggaatactatgcagccgtaaaaaagaataagatcatgtcctctgaaaagacatgggtggagctggaggccattatccttagcaaactaatgcaagaacagaaaaccaaacactgcatgttctcttataagtgagagctaaatggtgagaacacatggacatgggaacaacacattctggggtctattggagggtgggaggagggagaggatcaggaaaaataactaatgagtactaggcttaataccttggtgatgaaattatctgtacaacaaaccctcatgacacaagtttacctatgtaacaaacctgcacatgtacccctgtacttaacaacaaaataaacacaaaggaaaatgtt

SEQ ID NO: 161625 - DNA, 440 bp, Homo sapiens
  Payload ID: 11555
  Gene Symbol: NUDT9
  Gene Name: nudix (nucleoside diphosphate linked moiety X)-type motif 9
  ENST ID: ENST00000502933
  CDS Start-End: 25-258
cgcaaagccgccctcggggcgctcatggcgggacgcctcctgggaaaggctttagccgcggtgtctctctctctggccttggcctctgtgactatcaggtcctcgcgctgccgcggcatccaggcgttcagaaatcctgcaggacggactggactggtgggccgggggcttttggggcgatggggcccaaatcacgctgcagatcccattataaccaggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccat

SEQ ID NO: 161626 - DNA, 690 bp, Homo sapiens
  Payload ID: 11555
  Gene Symbol: NUDT9
  Gene Name: nudix (nucleoside diphosphate linked moiety X)-type motif 9
  ENST ID: ENST00000512216
  CDS Start-End: 73-690
gcgccattacgcagagagaaagttacgagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactc

SEQ ID NO: 161627 - DNA, 1969 bp, Homo sapiens
  Payload ID: 11556
  Gene Symbol: NUF2
  Gene Name: NUF2, NDC80 kinetochore complex component
  Uniprot ID: Q9BZD4
  ENST ID: ENST00000271452
  CDS Start-End: 280-1674
agtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatca

SEQ ID NO: 161628 - DNA, 1842 bp, Homo sapiens
  Payload ID: 11556
  Gene Symbol: NUF2
  Gene Name: NUF2, NDC80 kinetochore complex component
  Uniprot ID: Q9BZD4
  ENST ID: ENST00000367900
  CDS Start-End: 153-1547
ggaatggggcgggacttccagtaggaggcggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatca

SEQ ID NO: 161629 - DNA, 1133 bp, Homo sapiens
  Payload ID: 11556
  Gene Symbol: NUF2
  Gene Name: NUF2, NDC80 kinetochore complex component
  ENST ID: ENST00000442820
  CDS Start-End: 528-1133
ggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacg

SEQ ID NO: 161630 - DNA, 861 bp, Homo sapiens
  Payload ID: 11556
  Gene Symbol: NUF2
  Gene Name: NUF2, NDC80 kinetochore complex component
  ENST ID: ENST00000450453
  CDS Start-End: 427-861
tcttgagcccaaccggcatccgtcgcggttggacgtgggcttggcggaatggggcgggacttccagtaggaggcggcaagtttgaaaagtgatgacggttgacgtttgctgatttttgactttgcttgtagctgctccccgaactcgccgtcttcctgtcggcggccggcactgtaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatat

SEQ ID NO: 161631 - DNA, 567 bp, Homo sapiens
  Payload ID: 11556
  Gene Symbol: NUF2
  Gene Name: NUF2, NDC80 kinetochore complex component
  ENST ID: ENST00000534289
  CDS Start-End: 195-567
aatgcttattcattcttcaagattcagctcaaaattcacttttctctgtgaattcgtatgtcactccatctaccacacagcctctctcagcttcctcagaaaacagccatatgaaagccaagaagagagtcctcaccaggcaccttgaacttgcacttcccagactccagaaatattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcatta

SEQ ID NO: 161632 - DNA, 885 bp, Homo sapiens
  Payload ID: 11556
  Gene Symbol: NUF2
  Gene Name: NUF2, NDC80 kinetochore complex component
  ENST ID: ENST00000497990
  CDS Start-End: 42-707
tgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagt

SEQ ID NO: 161633 - DNA, 1845 bp, Homo sapiens
  Payload ID: 11556
  Gene Symbol: NUF2
  Gene Name: NUF2, NDC80 kinetochore complex component
  ENST ID: ENST00000524800
  CDS Start-End: 334-1587
aaccggcatccgtcgcggttggacgtgggcttggcggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagaagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagtt

SEQ ID NO: 161634 - DNA, 3342 bp, Homo sapiens
  Payload ID: 11557
  Gene Symbol: NUMB
  Gene Name: numb homolog (Drosophila)
  Uniprot ID: P49757
  ENST ID: ENST00000355058
  CDS Start-End: 19-1974
caggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagctttt

SEQ ID NO: 161635 - DNA, 3453 bp, Homo sapiens
  Payload ID: 11557
  Gene Symbol: NUMB
  Gene Name: numb homolog (Drosophila)
  Uniprot ID: P49757
  ENST ID: ENST00000356296
  CDS Start-End: 280-2091
gcttgagttggtcgggggcagcggcagctgagctgggatgggagacccaactggcctggccgctccggctctgaggatccctaagggaccaggaaagaagtcctcgaggagtggctcgcgtttgagaccgggatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaa

SEQ ID NO: 161636 - DNA, 3309 bp, Homo sapiens
  Payload ID: 11557
  Gene Symbol: NUMB
  Gene Name: numb homolog (Drosophila)
  Uniprot ID: P49757
  ENST ID: ENST00000359560
  CDS Start-End: 19-1941
caggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagctttt

SEQ ID NO: 161637 - DNA, 3198 bp, Homo sapiens
  Payload ID: 11557
  Gene Symbol: NUMB
  Gene Name: numb homolog (Drosophila)
  Uniprot ID: P49757
  ENST ID: ENST00000535282
  CDS Start-End: 19-1830
caggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagctttt

SEQ ID NO: 161638 - DNA, 2757 bp, Homo sapiens
  Payload ID: 11557
  Gene Symbol: NUMB
  Gene Name: numb homolog (Drosophila)
  Uniprot ID: P49757
  ENST ID: ENST00000544991
  CDS Start-End: 19-1389
caggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagctttt

SEQ ID NO: 161639 - DNA, 1406 bp, Homo sapiens
  Payload ID: 11557
  Gene Symbol: NUMB
  Gene Name: numb homolog (Drosophila)
  Uniprot ID: P49757
  ENST ID: ENST00000554521
  CDS Start-End: 40-1377
ggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtcca

SEQ ID NO: 161640 - DNA, 3547 bp, Homo sapiens
  Payload ID: 11557
  Gene Symbol: NUMB
  Gene Name: numb homolog (Drosophila)
  Uniprot ID: P49757
  ENST ID: ENST00000557597
  CDS Start-End: 263-2185
ggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaa

SEQ ID NO: 161641 - DNA, 3588 bp, Homo sapiens
  Payload ID: 11557
  Gene Symbol: NUMB
  Gene Name: numb homolog (Drosophila)
  Uniprot ID: P49757
  ENST ID: ENST00000555238
  CDS Start-End: 271-2226
gaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaa

SEQ ID NO: 161642 - DNA, 906 bp, Homo sapiens
  Payload ID: 11557
  Gene Symbol: NUMB
  Gene Name: numb homolog (Drosophila)
  ENST ID: ENST00000555859
  CDS Start-End: 236-906
cagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgc

SEQ ID NO: 161643 - DNA, 954 bp, Homo sapiens
  Payload ID: 11557
  Gene Symbol: NUMB
  Gene Name: numb homolog (Drosophila)
  ENST ID: ENST00000554394
  CDS Start-End: 179-954
tggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctca

SEQ ID NO: 161644 - DNA, 5172 bp, Homo sapiens
  Payload ID: 11557
  Gene Symbol: NUMB
  Gene Name: numb homolog (Drosophila)
  ENST ID: ENST00000556772
  CDS Start-End: 2289-3812
gaagcatacccatactaccaaggctaatctccttaacctaaattcaattcattgtaataatatttacagagtagcttctaatttgcccatagaatcaagatcaaagtccttatcaggaatagaaggccttctgtgattaggcctttcctactctatctcccattacgcctttcccattgccaagtctacttaccaagccatactgaaatatttatagagccccagacttgccatgttgtttgcttccatgtcctgtactgctgtttcttctgcctggcatgtccagtacctctgttacttccctgtctccctacccctacctaagcatcaagaaaaattattccagcacccagttcagtcttctcctttgtataaccttccccaattccacaaagagatttgattataccttttttctgacatcattgtaccttgttctcagctctactgtagcatttacctacggtattctttattttttgtctgattgttgcctttcagtaaccttccaggtatttccactggctggcatattataggcactcatcaaatttatggtggtggtggagatgatgaggccgagtggatcacaggttatttcagtaaggccatgtcctcatatcaagttttcctgggcttggatcacttatagaggagaatggtagttctaaaagtctcccttgtcgcttctagaggctgctgcgccaaccttagcaccagattccttttgatctatactttttatgataatctgatacctattctcagccttcatattgcttttgttttattttgctgtatccttgaggcagttaaaaagaaaggacactgttaaattactattacattccatcacaggaggaattatgcatcagcttgttctcatgtgattctcatgtgccaaaaagtattttctgagccaataaaaagaaaattattttttcagtagtttttaaatcttcctgtgtccccaaaatgtctccatgaatttaatgtcaaattaaaaaccaagccaaggctgggtacagtggtgcacacttgtagtcctggctacacgtggggctgggacaaggggatcacttgagcccaggagttcaaggctgtaatgctttatgatcatacctgtgaatagccactgcactccagcctgggcaacacagtgagacctcgtctctaaaattattagaggctgggcacagtggctcacacctgtaatcccagcactttgggaggctgaggcaggcggatcacttgaggtcaggagttccagaccagcctggccaacatggtgaaactccgtctctactagaaatacaaaaattagccgggcatggtggcaggtgcctgtaatcccagctagtcgggaggctgaggcaggagaatcacttaaacccgggatggggaggttgcagtgagccaatatcgcatcactgctctccagcctgggcgacagagtgagactctgtctcaagaaaaaaaaaaaattattaggaaaaatgtctgtgttaactctgagagaacaaataatggctttttaaagactgttaatagaataatgaagacttactgtgtttttaacgtgaaaattttaggtgaccaagggtcctgctataacatactgggggtcataggatagtagaatggtcaacatctcaatttagacatgttacttcctgctctaaatacacttgtggacgctacttgtggtgtaactccttatgtatttaataattatctgactctggttttcttggttgatttttttaaatgggtgaagaatctagttatgaattctttgccctttatggaatgtgatatcttggtttttattccatctgttacttcccttttacttaattttatcttattgttttgcgttgtgtttctaaaataatggctttggcttgttttttcctgaatgtttctgcagtttggtttgagtatctgggtttgggcaccactcctgaacttggactccatctgtacttgtgacttttggaaggcagagtcagtgttttctgtggaagatgacatttttttaatattatatatgtgtatctccccctcccctttttggtttctcttaaaagactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 161645 - DNA, 557 bp, Homo sapiens
  Payload ID: 11557
  Gene Symbol: NUMB
  Gene Name: numb homolog (Drosophila)
  ENST ID: ENST00000555987
  CDS Start-End: 318-557
gtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctacaggaactttgatagagccttttcttacatatgccgtg

SEQ ID NO: 161646 - DNA, 3037 bp, Homo sapiens
  Payload ID: 11557
  Gene Symbol: NUMB
  Gene Name: numb homolog (Drosophila)
  Uniprot ID: P49757
  ENST ID: ENST00000555394
  CDS Start-End: 321-2132
gttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaaccta

SEQ ID NO: 161647 - DNA, 552 bp, Homo sapiens
  Payload ID: 11557
  Gene Symbol: NUMB
  Gene Name: numb homolog (Drosophila)
  ENST ID: ENST00000554818
  CDS Start-End: 352-552
gcggagttctcccgaggaaggtaggctacggccggacccgcgcgggtcaggccaggaggtcccttgggacgtccagctgctccggtctagcgcgctgaccggcggccactgtgtgaggaatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagct

SEQ ID NO: 161648 - DNA, 1553 bp, Homo sapiens
  Payload ID: 11557
  Gene Symbol: NUMB
  Gene Name: numb homolog (Drosophila)
  Uniprot ID: P49757
  ENST ID: ENST00000555738
  CDS Start-End: 40-1524
ggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtcca

SEQ ID NO: 161649 - DNA, 1039 bp, Homo sapiens
  Payload ID: 11557
  Gene Symbol: NUMB
  Gene Name: numb homolog (Drosophila)
  ENST ID: ENST00000555307
  CDS Start-End: 264-1039
gagttctcccgaggaaggtaggctacggccggacccgcgcgggtcaggccaggaggtcccttgggacgtccagctgctccggtctagcgcgctgaccggcggccactgtgtgaggaatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctca

SEQ ID NO: 161650 - DNA, 3607 bp, Homo sapiens
  Payload ID: 11557
  Gene Symbol: NUMB
  Gene Name: numb homolog (Drosophila)
  Uniprot ID: P49757
  ENST ID: ENST00000554546
  CDS Start-End: 358-2136
caatggataggttagaagtatgaaagagggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttgcccatgaagggctgttctttcccctttcctttattagtaaatgaatttatttttcgttcttttggtcttactctccattctactgctgctgtaaatccctag

SEQ ID NO: 161651 - DNA, 1439 bp, Homo sapiens
  Payload ID: 11557
  Gene Symbol: NUMB
  Gene Name: numb homolog (Drosophila)
  Uniprot ID: P49757
  ENST ID: ENST00000559312
  CDS Start-End: 40-1410
ggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtcca

SEQ ID NO: 161652 - DNA, 1586 bp, Homo sapiens
  Payload ID: 11557
  Gene Symbol: NUMB
  Gene Name: numb homolog (Drosophila)
  Uniprot ID: P49757
  ENST ID: ENST00000560335
  CDS Start-End: 40-1557
ggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtcca

SEQ ID NO: 161653 - DNA, 3561 bp, Homo sapiens
  Payload ID: 11558
  Gene Symbol: NUMBL
  Gene Name: numb homolog (Drosophila)-like
  Uniprot ID: Q9Y6R0
  ENST ID: ENST00000252891
  CDS Start-End: 169-1998
aatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtgcccctcgggaaacgagggtgtgtgtagggcgctggtgaggccctagaacctttcctcctgagtcatggactgaaacagagtcagaaggatgtccctgagtgataacctctgagtcatagcgtggtaacaggtaccactgactcagcacctgccaggcgggtattaaaggagccaaaattaatcaccccatttctattccttacagagttagaatcaaggaataaaaaacaaatattatgaactgctggctgggcacagtggctcacgcctgtaatcccagcactttgggaggtcgaggcaggcagatcacttaaggtcaggagttcgagaccagcctggccgccatggagaaacccagtctctaccaaaaattcaaaaattagccgggcgtggtggcaggcgcctgtaattccaggaggctgaggcacaagaatcgcttgaacccaggcagcagaggttgcagtgacctgaggtcacaccattgcactcctgcctgggcaacagaatgagactctgtctcaaaaaaaaaaaacaaaaaaaaaaaaactacttctaattagctcaatattaatattttaacaagttgggttggtaacagtatatctttgcccatgctggcaaattcttgttttgtcagcattttccataactctggccaaagtgtcacctgatgtggcaacgttttacagtcttgctattgtttcttgagtcctttaatctataagatgtatttttaaaaatatataacatataaattttgtttcgttatagctctttaaaa

SEQ ID NO: 161654 - DNA, 1931 bp, Homo sapiens
  Payload ID: 11558
  Gene Symbol: NUMBL
  Gene Name: numb homolog (Drosophila)-like
  ENST ID: ENST00000540131
  CDS Start-End: 98-1804
aaaccaaggcctccaggacgcgattccagacacaatccctacctctccctgcctaagggggtctcagcacaacaactgcctagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctc

SEQ ID NO: 161655 - DNA, 640 bp, Homo sapiens
  Payload ID: 11558
  Gene Symbol: NUMBL
  Gene Name: numb homolog (Drosophila)-like
  ENST ID: ENST00000600967
  CDS Start-End: 1-640
gtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactc

SEQ ID NO: 161656 - DNA, 834 bp, Homo sapiens
  Payload ID: 11558
  Gene Symbol: NUMBL
  Gene Name: numb homolog (Drosophila)-like
  ENST ID: ENST00000598773
  CDS Start-End: 130-834
gcggtgacggtgacggcggctttgtgtgtgggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgag

SEQ ID NO: 161657 - DNA, 559 bp, Homo sapiens
  Payload ID: 11558
  Gene Symbol: NUMBL
  Gene Name: numb homolog (Drosophila)-like
  ENST ID: ENST00000595741
  CDS Start-End: 213-559
agaagcaactctttcggacgcggagctggaggggatctgaggtcaggtgtcacggagggaaagggagcccaggccaggacggaccgggggaaaggactcggcgatgttcatagggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggcttt

SEQ ID NO: 161658 - DNA, 555 bp, Homo sapiens
  Payload ID: 11558
  Gene Symbol: NUMBL
  Gene Name: numb homolog (Drosophila)-like
  ENST ID: ENST00000600636
  CDS Start-End: 225-555
agatggggatggagatggggtcggggacacagcccccgtatcaaaccaaggcctccaggacgcgattccagacacaatccctacctctccctgcctaagggggtctcagcacaacaactgcctagggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgca

SEQ ID NO: 161659 - DNA, 2249 bp, Homo sapiens
  Payload ID: 11558
  Gene Symbol: NUMBL
  Gene Name: numb homolog (Drosophila)-like
  ENST ID: ENST00000598779
  CDS Start-End: 109-1815
accgcagcagcagcagtcggggagccaggcccagccagggccgcgggaggcgggggcgcccgggccctggatgtcccgcagcgcggcggccagcacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcc

SEQ ID NO: 161660 - DNA, 1755 bp, Homo sapiens
  Payload ID: 11559
  Gene Symbol: NRM
  Gene Name: nurim (nuclear envelope membrane protein)
  Uniprot ID: Q8IXM6
  ENST ID: ENST00000259953
  CDS Start-End: 353-1141
atttgccattcttagcaactggccagtcaacaactcaactttataatgggaaaactagacgagctgagattcaacccacgtgagcggctgcagagccgctacccttaacagctctctctcgggattctaacattcccttctgtgacggagagacagcaggccgggacacgcatcccaggacggatccacagctggatggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacata

SEQ ID NO: 161661 - DNA, 1228 bp, Homo sapiens
  Payload ID: 11559
  Gene Symbol: NRM
  Gene Name: nurim (nuclear envelope membrane protein)
  Uniprot ID: Q8IXM6
  ENST ID: ENST00000376420
  CDS Start-End: 3-614
ccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacata

SEQ ID NO: 161662 - DNA, 1734 bp, Homo sapiens
  Payload ID: 11559
  Gene Symbol: NRM
  Gene Name: nurim (nuclear envelope membrane protein)
  Uniprot ID: Q8IXM6
  ENST ID: ENST00000376421
  CDS Start-End: 335-1123
tggtaaaacagtaacttttcattttagatgggaaaactagacgagctgagattcaacccacgtgagcggctgcagagccgctacccttaacagctctctctcgggattctaacattcccttctgtgacggagagacagcaggccgggacacgcatcccaggacggatccacagctggatggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctac

SEQ ID NO: 161663 - DNA, 1228 bp, Homo sapiens; identical to SEQ ID NO: 161661
  Payload ID: 11559
  Gene Symbol: NRM
  Gene Name: nurim (nuclear envelope membrane protein)
  Uniprot ID: Q8IXM6
  ENST ID: ENST00000383570
  CDS Start-End: 3-614

SEQ ID NO: 161664 - DNA, 1755 bp, Homo sapiens; identical to SEQ ID NO: 161660
  Payload ID: 11559
  Gene Symbol: NRM
  Gene Name: nurim (nuclear envelope membrane protein)
  Uniprot ID: Q8IXM6
  ENST ID: ENST00000383571
  CDS Start-End: 353-1141

SEQ ID NO: 161665 - DNA, 1401 bp, Homo sapiens
  Payload ID: 11559
  Gene Symbol: NRM
  Gene Name: nurim (nuclear envelope membrane protein)
  ENST ID: ENST00000446443
  CDS Start-End: 1-787
tgaaagcggccgagaagctacaggggagggagacctgagttctaaattaggaactcaaggattagagttttggagaggcgggagagtgaggactgagggagccgaaaagggcggtgaccggagtattctaaatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacata

SEQ ID NO: 161666 - DNA, 1228 bp, Homo sapiens; identical to SEQ ID NO: 161661
  Payload ID: 11559
  Gene Symbol: NRM
  Gene Name: nurim (nuclear envelope membrane protein)
  Uniprot ID: Q8IXM6
  ENST ID: ENST00000445058
  CDS Start-End: 3-614

SEQ ID NO: 161667 - DNA, 1228 bp, Homo sapiens; identical to SEQ ID NO: 161661
  Payload ID: 11559
  Gene Symbol: NRM
  Gene Name: nurim (nuclear envelope membrane protein)
  Uniprot ID: Q8IXM6
  ENST ID: ENST00000456720
  CDS Start-End: 3-614

SEQ ID NO: 161668 - DNA, 1228 bp, Homo sapiens; identical to SEQ ID NO: 161661
  Payload ID: 11559
  Gene Symbol: NRM
  Gene Name: nurim (nuclear envelope membrane protein)
  Uniprot ID: Q8IXM6
  ENST ID: ENST00000422664
  CDS Start-End: 3-614

SEQ ID NO: 161669 - DNA, 1401 bp, Homo sapiens; identical to SEQ ID NO: 161665
  Payload ID: 11559
  Gene Symbol: NRM
  Gene Name: nurim (nuclear envelope membrane protein)
  ENST ID: ENST00000434776
  CDS Start-End: 1-787

SEQ ID NO: 161670 - DNA, 1755 bp, Homo sapiens; identical to SEQ ID NO: 161660
  Payload ID: 11559
  Gene Symbol: NRM
  Gene Name: nurim (nuclear envelope membrane protein)
  Uniprot ID: Q8IXM6
  ENST ID: ENST00000438502
  CDS Start-End: 353-1141

SEQ ID NO: 161671 - DNA, 1401 bp, Homo sapiens; identical to SEQ ID NO: 161665
  Payload ID: 11559
  Gene Symbol: NRM
  Gene Name: nurim (nuclear envelope membrane protein)
  ENST ID: ENST00000444096
  CDS Start-End: 1-787

SEQ ID NO: 161672 - DNA, 1755 bp, Homo sapiens; identical to SEQ ID NO: 161660
  Payload ID: 11559
  Gene Symbol: NRM
  Gene Name: nurim (nuclear envelope membrane protein)
  Uniprot ID: Q8IXM6
  ENST ID: ENST00000431322
  CDS Start-End: 353-1141

SEQ ID NO: 161673 - DNA, 1228 bp, Homo sapiens; identical to SEQ ID NO: 161661
  Payload ID: 11559
  Gene Symbol: NRM
  Gene Name: nurim (nuclear envelope membrane protein)
  Uniprot ID: Q8IXM6
  ENST ID: ENST00000449041
  CDS Start-End: 3-614

SEQ ID NO: 161674 - DNA, 1755 bp, Homo sapiens; identical to SEQ ID NO: 161660
  Payload ID: 11559
  Gene Symbol: NRM
  Gene Name: nurim (nuclear envelope membrane protein)
  Uniprot ID: Q8IXM6
  ENST ID: ENST00000427944
  CDS Start-End: 353-1141

SEQ ID NO: 161675 - DNA, 1401 bp, Homo sapiens; identical to SEQ ID NO: 161665
  Payload ID: 11559
  Gene Symbol: NRM
  Gene Name: nurim (nuclear envelope membrane protein)
  ENST ID: ENST00000411883
  CDS Start-End: 1-787

SEQ ID NO: 161676 - DNA, 1228 bp, Homo sapiens; identical to SEQ ID NO: 161661
  Payload ID: 11559
  Gene Symbol: NRM
  Gene Name: nurim (nuclear envelope membrane protein)
  Uniprot ID: Q8IXM6
  ENST ID: ENST00000450138
  CDS Start-End: 3-614

SEQ ID NO: 161677 - DNA, 1401 bp, Homo sapiens; identical to SEQ ID NO: 161665
  Payload ID: 11559
  Gene Symbol: NRM
  Gene Name: nurim (nuclear envelope membrane protein)
  ENST ID: ENST00000444252
  CDS Start-End: 1-787

SEQ ID NO: 161678 - DNA, 1401 bp, Homo sapiens; identical to SEQ ID NO: 161665
  Payload ID: 11559
  Gene Symbol: NRM
  Gene Name: nurim (nuclear envelope membrane protein)
  ENST ID: ENST00000430286
  CDS Start-End: 1-787

SEQ ID NO: 161679 - DNA, 1755 bp, Homo sapiens; identical to SEQ ID NO: 161660
  Payload ID: 11559
  Gene Symbol: NRM
  Gene Name: nurim (nuclear envelope membrane protein)
  Uniprot ID: Q8IXM6
  ENST ID: ENST00000422181
  CDS Start-End: 353-1141

SEQ ID NO: 161680 - DNA, 1401 bp, Homo sapiens; identical to SEQ ID NO: 161665
  Payload ID: 11559
  Gene Symbol: NRM
  Gene Name: nurim (nuclear envelope membrane protein)
  ENST ID: ENST00000436892
  CDS Start-End: 1-787

SEQ ID NO: 161681 - DNA, 1755 bp, Homo sapiens; identical to SEQ ID NO: 161660
  Payload ID: 11559
  Gene Symbol: NRM
  Gene Name: nurim (nuclear envelope membrane protein)
  Uniprot ID: Q8IXM6
  ENST ID: ENST00000422747
  CDS Start-End: 353-1141

SEQ ID NO: 161682 - DNA, 1734 bp, Homo sapiens; identical to SEQ ID NO: 161662
  Payload ID: 11559
  Gene Symbol: NRM
  Gene Name: nurim (nuclear envelope membrane protein)
  Uniprot ID: Q8IXM6
  ENST ID: ENST00000617159
  CDS Start-End: 335-1123

SEQ ID NO: 161683 - DNA, 1734 bp, Homo sapiens; identical to SEQ ID NO: 161662
  Payload ID: 11559
  Gene Symbol: NRM
  Gene Name: nurim (nuclear envelope membrane protein)
  Uniprot ID: Q8IXM6
  ENST ID: ENST00000613827
  CDS Start-End: 335-1123

SEQ ID NO: 161684 - DNA, 1734 bp, Homo sapiens; identical to SEQ ID NO: 161662
  Payload ID: 11559
  Gene Symbol: NRM
  Gene Name: nurim (nuclear envelope membrane protein)
  Uniprot ID: Q8IXM6
  ENST ID: ENST00000610775
  CDS Start-End: 335-1123

SEQ ID NO: 161685 - DNA, 1734 bp, Homo sapiens; identical to SEQ ID NO: 161662
  Payload ID: 11559
  Gene Symbol: NRM
  Gene Name: nurim (nuclear envelope membrane protein)
  Uniprot ID: Q8IXM6
  ENST ID: ENST00000612190
  CDS Start-End: 335-1123

SEQ ID NO: 161686 - DNA, 1734 bp, Homo sapiens; identical to SEQ ID NO: 161662
  Payload ID: 11559
  Gene Symbol: NRM
  Gene Name: nurim (nuclear envelope membrane protein)
  Uniprot ID: Q8IXM6
  ENST ID: ENST00000620249
  CDS Start-End: 335-1123

SEQ ID NO: 161687 - DNA, 1734 bp, Homo sapiens; identical to SEQ ID NO: 161662
  Payload ID: 11559
  Gene Symbol: NRM
  Gene Name: nurim (nuclear envelope membrane protein)
  Uniprot ID: Q8IXM6
  ENST ID: ENST00000617220
  CDS Start-End: 335-1123

SEQ ID NO: 161688 - DNA, 4676 bp, Homo sapiens
  Payload ID: 11560
  Gene Symbol: NUS1
  Gene Name: NUS1 dehydrodolichyl diphosphate synthase subunit
  Uniprot ID: Q96E22
  ENST ID: ENST00000368494
  CDS Start-End: 170-1051
gaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtctgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgactttttttttttgttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactatagtattatgtgaatgctacatttgttctgaacacttaggggctgcaaaaatgtaataagaaatgcatatgactagatagcaatagtgttttttttagatggtatgctcttgattgaaatatattctcacttttaccaggttaaacatttggaatcttataatgttacttgctttttgatagataatagtgaaataaattcagctttgccattgctggagttgtcaaaattccacagtaattaaaatttgaatttttaccgaatatgaaatttccaaattaaaaacgtatatgtgtactcttttaaaaaggaatttgatagttcttgtcaaatgagaaaatttaaaggtaagagttatggtttgtcttatgctgcatagactattcacctcctaacttgaaggtctaatcataagacaattgtttttttgtgcatagttttcatctaaaattaagtttaccaaaggcaaataactgcttactaggaacttcctttagcaaaaattactataaagttcaggacagtttgaaataaaacccaggaaacaagattaatgtgagcagttctccaagatcctaactggtgggacataaactatgatgcaatggataggaaaaggtagtgcaaaaagaatttcttaaggtttaaaaaatacacttttcattataggaaaaagaagattcagagaaacaaaggaatgtaaccttattgattacatttttggtgatcaccgagaattttttgtactatattttaaaaaatgtattctactgtaacaagttaataaagagattttttaaaaaactataaactagaaa

SEQ ID NO: 161689 - DNA, 3974 bp, Homo sapiens
  Payload ID: 11561
  Gene Symbol: NUTM2A
  Gene Name: NUT family member 2A
  Uniprot ID: Q8IVF1
  ENST ID: ENST00000381689
  CDS Start-End: 332-2221
ggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagggagccccttcagatgctccagggactgacagatgctgaggaagccctgatccctcccaccacccactcacaaggccctgcctgctttagggaggcttcttggggcccccccatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggtgtttctgctggttccagggcccggaggagctggggcccaggccaagaggggccgagggtctgccgcccttctgccaggcacagaccccaagggcagagcaggggctgcctgggatgtggcattggctgtctgggaagtgccctgggagttgggggctaggtgttcgccaaagagagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctactggttaccccactggctgttgtctatcctactgtccctgtccttgtcttggctgagccattcctaggaagcagaacttgtgcttcctccacctctgtgtcccacctgagccctacaatctgcccctaaatgggcacagtggggctgactggggggctctg

SEQ ID NO: 161690 - DNA, 3290 bp, Homo sapiens
  Payload ID: 11561
  Gene Symbol: NUTM2A
  Gene Name: NUT family member 2A
  Uniprot ID: Q8IVF1
  ENST ID: ENST00000381707
  CDS Start-End: 384-3020
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaaaa

SEQ ID NO: 161691 - DNA, 2239 bp, Homo sapiens
  Payload ID: 11562
  Gene Symbol: NUTM2B
  Gene Name: NUT family member 2B
  ENST ID: ENST00000342531
  CDS Start-End: 1-1969
cctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagctagtggagaagcgcctcccacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagatgactgcccgggactctcagggacgaggcagagcacacactggcatggccaggtccgaagactctgttgtgcttttgggatgtcaggattcccctgggctgagggctgcctggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccctacccagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggccaatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaaaa

SEQ ID NO: 161692 - DNA, 3970 bp, Homo sapiens
  Payload ID: 11562
  Gene Symbol: NUTM2B
  Gene Name: NUT family member 2B
  ENST ID: ENST00000372321
  CDS Start-End: 533-2221
ggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagggagccccttcagatgctccagggactgacagatgctgaggaagccctgatccctcccactaccgactcacaaggccctgcctgctttagggaggcttcttggggccccccatcgtcatcagcatccctggaaaatcctgggattggagagagctggctggctcttgttctgctcggtgggagctgaggagaaggcagccacctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaaacatgtccagtccatcaggcgcagggtgggtgtttctgctggttccagggcccggaggagctggggcccaggccaagaggggccgagggtcagccgcccttctgccaggcacagaccccaagggcagagcaggggctgcctgggatgtggcattggctgtctgggaagtgacctgggagttgggggctaggtgttcgccaaagggagacttccagagtctacgagtgagatgaggactgcatcaggagagggaccgaggctggggaggatgctctgctctttcccaggttgtcctgtcctcccaatctctgctgaactgccctcaccccatgggccaacttctgccccccttacccctaacccacctcttagaatctcagatcccagcatggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggcgctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacatcaggccctcggggaaaatgtggggagcgaagagtcactggtgggtgatgtgggcagctcccgtgactcctctacattcagggccatcctcaagagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggc

SEQ ID NO: 161693 - DNA, 3292 bp, Homo sapiens
  Payload ID: 11562
  Gene Symbol: NUTM2B
  Gene Name: NUT family member 2B
  Uniprot ID: A6NNL0
  ENST ID: ENST00000429828
  CDS Start-End: 384-3020
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagctagtggagaagcgcctcccacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagatgactgcccgggactctcagggacgaggcagagcacacactggcatggccaggtccgaagactctgttgtgcttttgggatgtcaggattcccctgggctgagggctgcctggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccctacccagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggccaatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaaaatg

SEQ ID NO: 161694 - DNA, 3290 bp, Homo sapiens
  Payload ID: 11563
  Gene Symbol: NUTM2D
  Gene Name: NUT family member 2D
  Uniprot ID: Q5VT03
  ENST ID: ENST00000381697
  CDS Start-End: 599-3019
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttggaaaa

SEQ ID NO: 161695 - DNA, 5543 bp, Homo sapiens
  Payload ID: 11563
  Gene Symbol: NUTM2D
  Gene Name: NUT family member 2D
  ENST ID: ENST00000412718
  CDS Start-End: 547-2220
ggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagggagccccttcagatgctccagggactgacagatgctgaggaagccctgatccctcccaccacccactcacaaggccctgcctgctttagggaggcttcttggggccccctcatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggggtttctgctggttccagggcccggaggagctggggcccaggccaagaggggccgagggtcagccgcccttctgccaggcacagaccccaagggcagagcaggggctgcctgggatgtggcattggctgtctgggaagtgccctgggagttgggggctaggtgttcgccaaagggagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacgaggacacactgagaaggcggccatctgcaagccagagagagagccctcaccagaaccttgcccactgggatgctaacctcggacttccagcctccagactgtgacaaatacatttctttttttaatatgtgccaccacccccaagtctatggccctttgtccgagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacatgaaccaggagagcctgggacacagtgaaaaggaatctgtaaatacccatgatgtcatcgcatccacacttggggaagccatgcagcttgctcacagcaggtgctgggggtgtgctgaggctcttggtcggcttggcctccctgctcacacacccaggtcactctctgggaaccagtgcggctggggtggcccctggcaggtttgcctccagagacccctcccttcaccattggatgacagatccccgaagaagccatagcctcctgggaaactccatctgacaacgtgagcaaggcttgcccccgttagtgaacatgctgtgctttctgacagctatgaggatggacttgatccaggtggctgcccttttgtagctcactttgattctaacttcagcgttgcatgatgccctatgaatggaatatacaatgtgtgtctttcacatctgtcttctttcacttagaataatatttccaatggcatctacatttttagtatgtatcattacatcaaacctttttgttgctgaataatattccattaatggatatactaaaatttatccatttatcagttaagaacgtttgggtttttttcactttttggctattgtgaataacacttctaagaacatttgtgtacaaggtttcctggggatgtatgtttccatttctcatggctacatacctaagagtgaaattggtggaccatatggaaactctgtgtttaaccatttcagaaggtgccagactgttcccagtgtacatgaaccattttatatacccactagctgtgtgagggtcccagcgtctctccatattcgagccaacatttattatcaactctctttttgataaagtcatcctagtggttctgaagttgcatctcatcgtagtttgcatttgtgtttctctgatgttgaacctctttcacgtacctattcgccacttgtatatcttctttggagcaatgtgtactcaacatttagtaatttttaactggtttgtgttttgtcattgagttataagaattctttatatattccagataaaaatgctttacaag

SEQ ID NO: 161696 - DNA, 1018 bp, Homo sapiens
  Payload ID: 11563
  Gene Symbol: NUTM2D
  Gene Name: NUT family member 2D
  ENST ID: ENST00000465545
  CDS Start-End: 1-458
aggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccccgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttgga

SEQ ID NO: 161697 - DNA, 2901 bp, Homo sapiens
  Payload ID: 11563
  Gene Symbol: NUTM2D
  Gene Name: NUT family member 2D
  ENST ID: ENST00000620936
  CDS Start-End: 1-2634
atggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctttcagttggactcaggagcatctggtgagccaggtcactctctgggtcttacccttggcttttctcattgtggaaactgccagacagcggtagtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttgg

SEQ ID NO: 161698 - DNA, 3292 bp, Homo sapiens
  Payload ID: 11564
  Gene Symbol: NUTM2E
  Gene Name: NUT family member 2E
  Uniprot ID: B1AL46
  ENST ID: ENST00000429984
  CDS Start-End: 384-3020
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcagcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggcccagactgcctgcctgccaccacccagaccccagaggccagtgaccaaggcccgccggccaccaccccagccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagctagtggagaagcgcctcccacccttgaaggagaaacagcattcgagggcagcccctagtcgtggcacagcccggttggactcaagttcttctaagtttgcagctggccaaggagcagagagagacgtccctgacccccaagaaggggttggcatggaaacctgcccaccccagacgactgcccgggactctcagggacgaggcagagcacacactggcatggccaggtccgaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcaacctctctttggaagcctgtcccctgctgaaaagacaccccaccgagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggccaatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgtgttgggggcctcgtgtgtaagtgtgaataaatgtagttgtcttggaaaatg

SEQ ID NO: 161699 - DNA, 3623 bp, Homo sapiens
  Payload ID: 11564
  Gene Symbol: NUTM2E
  Gene Name: NUT family member 2E
  ENST ID: ENST00000602967
  CDS Start-End: 384-2360
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcagcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggcccagactgcctgcctgccaccacccagaccccagaggccagtgaccaaggcccgccggccaccaccccagccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccaggtaccccaggggcaggagggacctggcacacaaggcccacctgattgtctaatcccccccgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccctgctcacacctggggcagtgccagtaagtgccccctttcctcccgcagctagtggagaagcgcctcccacccttgaaggagaaacagcattcgagggcagcccctagtcgtggcacagcccggttggactcaagttcttctaagtttgcagctggccaaggagcagagagagacgtccctgacccccaagaaggggttggcatggaaacctgcccaccccagacgactgcccgggactctcagggacgaggcagagcacacactggcatggccaggtccgaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcaacctctctttggaagcctgtcccctgctgaaaagacaccccaccgagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggccaatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgtgttgggggcctcgtgtgtaagtgtgaataaatgtagttgtcttggaaaa

SEQ ID NO: 161700 - DNA, 2561 bp, Homo sapiens
  Payload ID: 11565
  Gene Symbol: NUTM2F
  Gene Name: NUT family member 2F
  Uniprot ID: A1L443
  ENST ID: ENST00000253262
  CDS Start-End: 22-2292
gtcagtgcccagcctgaggggatggcttcaaatggagcatacccagtgctgggacccggcgtgaccgtgaaccctggcacctccctgtctgtgttcacggctctgccctttgccacacccgctcccggcccagcacacaggccgcccctcgtgactgcagtggttcctccagccggccctctggtgctctctgccttccccagcacccctctagtggcaggacaggatggccgcggcccgagtggggccggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctaggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaacgcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacagctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 161701 - DNA, 2516 bp, Homo sapiens
  Payload ID: 11565
  Gene Symbol: NUTM2F
  Gene Name: NUT family member 2F
  ENST ID: ENST00000341207
  CDS Start-End: 22-2247
gtcagtgcccagcctgaggggatggcttcaaatggagcatacccagtgctgggacccggcgtgaccgtgaaccctggcacctccctgtctgtgttcacggctctgccctttgccacacccgctcccggcccagcacacaggccgcccctcgtgactgcagtggttcctccagccggccctctggtgctctctgccttccccagcacccctctagtggcaggacaggatggccgcggcccgagtggggccggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctaggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacagctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 161702 - DNA, 2851 bp, Homo sapiens
  Payload ID: 11566
  Gene Symbol: NUTM2G
  Gene Name: NUT family member 2G
  Uniprot ID: Q5VZR2
  ENST ID: ENST00000354649
  CDS Start-End: 716-2194
cttcctaagaaaggggacgggaagtaaggctggcctactggtgtggacagattccagcaacatacatgacctgggggcacaaggactgcttcctaaacaatgatgagcacacagccacctaatagcctggatcagctgaggccattctgatttcaaacactcagtccccttgccttcctaagaacccctgtgtttctcagactgaaaacgtgttctgaattttgttaagtaagtgtggcccctgttgaaattcatcaagagtgggaaagagccaaagtgggaaggagcatgggttgattggcacaaaagtaggtctgttgataaagaatggaagtaaaggggacatcaggtagaagcttttgctgtgagtcagaaggacaatttaaaagttgcctaaagaggcgcacactgtctgtgttgctgccatccagttggatggcaaccaactgaaccaagggaacctcaggttcttgcctactggccagagcccttcacagaatgtcccccacccccgccaagcccggctgcccactgcccctccccctctgcagaatgtctggggtcctgtgttccaaacctgtttatatgcaaattatccctgctccacttggactcaggaggatctgctgagtcaggtcactctctgggtcctgcccttgacttttttcattgcggaagctgccagacagtggtggtcagtgcccagcctgaggggatggcttcaaatggagcatacccagtgctgggacccggcgtgaccgtgaaccctggcacctccctgtctgtgttcacggctctgccctttgccacaccctctcccggcccaacacacaggccgcccctcgtgactgcagtggttcctccagccggccctctggtgctctctgccttccccagcacccctctagtggcaggacaggatggccgcggcccaagtggggctggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctgggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcgggccatgcgggaatggcagcacacgagcaactttgaccggatgattttctacgagatggcggcaaagttcctggagtttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggcccccgaggccagcagagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggatgacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagggggccccttcagatgctctggggactgacagatgctgaggaagccctgatccctcccaccatccactcacaaggccccgcctgctttagggaggcttctcggggcctcccatcattatcagtatccctggaaaatcctgggatggagagagctggctggctttttttctgctcggtgggagctgaggagaaggcagctgcctgcaacatggacatggggagaggcggctgctcctgcttaaccctcatcaggaagagcacgggcactgggctgaggggagacgttgaggtgaccgtccacatgggtgtgtttgggatatgatgaggggcgcagagcaggggcctgtttctgggcaggagagagtcttgtccaactggctgaagcagatgctccttgctgtggccacatggaatggcctcaggggccctcagggtcttgcatggagctcccccaacagctatgattcccttcccatatgatgactgaactcgtgtggaattgatgtagacacagatttacattggcatctaaaacagttccctcccaacacaccatcaccaacgggaacaagcatgaccagcctgccaggcgcaaggtgggtgtgtctgctggtcccagggccaggagaagctggggcccaggccgagaggggccgagggtcagtcgcccttctgccaggcacagaccccaagggc

SEQ ID NO: 161703 - DNA, 2516 bp, Homo sapiens
  Payload ID: 11566
  Gene Symbol: NUTM2G
  Gene Name: NUT family member 2G
  Uniprot ID: Q5VZR2
  ENST ID: ENST00000372322
  CDS Start-End: 22-2247
gtcagtgcccagcctgaggggatggcttcaaatggagcatacccagtgctgggacccggcgtgaccgtgaaccctggcacctccctgtctgtgttcacggctctgccctttgccacaccctctcccggcccaacacacaggccgcccctcgtgactgcagtggttcctccagccggccctctggtgctctctgccttccccagcacccctctagtggcaggacaggatggccgcggcccaagtggggctggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctgggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcgggccatgcgggaatggcagcacacgagcaactttgaccggatgattttctacgagatggcggcaaagttcctggagtttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggcccccgaggccagcagagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggatgacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacggctgcccaggaccctcagggacagggcagagtgcgcactggcatggccaggtccgaagaccctgctgtgcttttgggatgtcaggactcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcaatctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 161704 - DNA, 3795 bp, Homo sapiens
  Payload ID: 11567
  Gene Symbol: NUTM1
  Gene Name: NUT midline carcinoma, family member 1
  Uniprot ID: Q86Y26
  ENST ID: ENST00000333756
  CDS Start-End: 156-3554
gagttccgtattctagttctgtgtgatctgatctttaccttcccttccttggatccctgtgcacctactggagccaggttactctgggtcctggacctgactgcctcattctggaggcttccagacagccacagttagtgcccaaacctgagaggatggcttcagatggagcatctgcattgccgggaccggatatgagcatgaaacctagtgccgccccgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggatgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcagccagaacttgcagctccacagggaactccgggacccttgggtgtggagaggagagggtctgggaaggttataaaccaggtatctctacatcaggatggccatctaggaggcgctgggcctcctgggcactgcctggtggctgataggacttcagaggctctgcccctttgttggcagggaggcttccagcctgagagcactcccagtttggatgctggacttgcagagctggctcctctgcaaggacaagggttagaaaagcaagtcctgggattgcagaaaggacaacaaacagggggtcgtggagtgcttcctcaagggaaggagcctttagcagtgccctgggaaggctcttcaggagccatgtggggagatgacagaggtacccccatggctcagagttatgatcagaatccttcccctagagcagctggggagagggacgatgtctgtctcagcccaggagtttggctgagcagtgagatggatgctgtaggcttggagctgcctgtacaaatagaggaggtcatagagagcttccaagttgagaagtgtgtaactgagtatcaggaaggctgccagggactgggctccaggggcaacatttccctgggtcctggagaaaccctagtacctggggatacggagagcagtgtgattccctgtggaggcacagttgcggcagctgccctagaaaagagaaactattgcagcttgccaggacctttgagggccaacagcccacccttgaggtccaaagaaaatcaagaacagagctgtgaaaccgtagggcatcccagtgatctgtgggcagaaggttgcttcccattgctagaaagtggtgattccacactggggtcttccaaagaaacccttccacccacatgccaaggcaatctccttatcatggggactgaggatgcctcctccttgcctgaagccagtcaagaggcagggagcagaggcaattccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttggaaaa

SEQ ID NO: 161705 - DNA, 3922 bp, Homo sapiens
  Payload ID: 11567
  Gene Symbol: NUTM1
  Gene Name: NUT midline carcinoma, family member 1
  Uniprot ID: Q86Y26
  ENST ID: ENST00000438749
  CDS Start-End: 224-3676
acccatttcaggagcagtgagttttcaatgcctgaagaaacaagggctccaggattcagagcccctttaccctagggaagaaagaagaggttttcttccctcccctcttttacatccagttcccctgctccatttcaaagcgttggcggtaaagaatgcatgttgagtatcaatattccgtaaagcgaaagagcgtaaagttattttatgaaactggtgaagcatgtttcagcggtcgaaccaagatttaaagttaggtccctaccgcaaattcagcgctctttcttatggtgcatctgcattgccgggaccggatatgagcatgaaacctagtgccgccccgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggatgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcagccagaacttgcagctccacagggaactccgggacccttgggtgtggagaggagagggtctgggaaggttataaaccaggtatctctacatcaggatggccatctaggaggcgctgggcctcctgggcactgcctggtggctgataggacttcagaggctctgcccctttgttggcagggaggcttccagcctgagagcactcccagtttggatgctggacttgcagagctggctcctctgcaaggacaagggttagaaaagcaagtcctgggattgcagaaaggacaacaaacagggggtcgtggagtgcttcctcaagggaaggagcctttagcagtgccctgggaaggctcttcaggagccatgtggggagatgacagaggtacccccatggctcagagttatgatcagaatccttcccctagagcagctggggagagggacgatgtctgtctcagcccaggagtttggctgagcagtgagatggatgctgtaggcttggagctgcctgtacaaatagaggaggtcatagagagcttccaagttgagaagtgtgtaactgagtatcaggaaggctgccagggactgggctccaggggcaacatttccctgggtcctggagaaaccctagtacctggggatacggagagcagtgtgattccctgtggaggcacagttgcggcagctgccctagaaaagagaaactattgcagcttgccaggacctttgagggccaacagcccacccttgaggtccaaagaaaatcaagaacagagctgtgaaaccgtagggcatcccagtgatctgtgggcagaaggttgcttcccattgctagaaagtggtgattccacactggggtcttccaaagaaacccttccacccacatgccaaggcaatctccttatcatggggactgaggatgcctcctccttgcctgaagccagtcaagaggcagggagcagaggcaattccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttggaaaatgctc

SEQ ID NO: 161706 - DNA, 4102 bp, Homo sapiens
  Payload ID: 11567
  Gene Symbol: NUTM1
  Gene Name: NUT midline carcinoma, family member 1
  Uniprot ID: Q86Y26
  ENST ID: ENST00000537011
  CDS Start-End: 383-3865
ctactgtgtgctaggtacacggcgttagaggggggtagggatggatgtggatagaatattgacgtatagaagcctgtctttgtctcaagatacacacccatttcaggagcagtgagttttcaatgcctgaagaaacaagggctccaggattcagagcccctttaccctagggaagaaagaagaggttttcttccctcccctcttttacatccagttcccctgctccatttcaaagcgttggcggtaaagaatgcatgttgagtatcaatattccgtaaagcgaaagagcgtaaagttattttatgaaactggtgaagcatgtttcagcggtcgaaccaagatttaaagttaggtccctaccgcaaattcagcgctctttcttatggtggttactctgggtcctggacctgactgcctcattctggaggcttccagacagccacagttagtgcccaaacctgagaggatggcttcagatggagcatctgcattgccgggaccggatatgagcatgaaacctagtgccgccccgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggatgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcagccagaacttgcagctccacagggaactccgggacccttgggtgtggagaggagagggtctgggaaggttataaaccaggtatctctacatcaggatggccatctaggaggcgctgggcctcctgggcactgcctggtggctgataggacttcagaggctctgcccctttgttggcagggaggcttccagcctgagagcactcccagtttggatgctggacttgcagagctggctcctctgcaaggacaagggttagaaaagcaagtcctgggattgcagaaaggacaacaaacagggggtcgtggagtgcttcctcaagggaaggagcctttagcagtgccctgggaaggctcttcaggagccatgtggggagatgacagaggtacccccatggctcagagttatgatcagaatccttcccctagagcagctggggagagggacgatgtctgtctcagcccaggagtttggctgagcagtgagatggatgctgtaggcttggagctgcctgtacaaatagaggaggtcatagagagcttccaagttgagaagtgtgtaactgagtatcaggaaggctgccagggactgggctccaggggcaacatttccctgggtcctggagaaaccctagtacctggggatacggagagcagtgtgattccctgtggaggcacagttgcggcagctgccctagaaaagagaaactattgcagcttgccaggacctttgagggccaacagcccacccttgaggtccaaagaaaatcaagaacagagctgtgaaaccgtagggcatcccagtgatctgtgggcagaaggttgcttcccattgctagaaagtggtgattccacactggggtcttccaaagaaacccttccacccacatgccaaggcaatctccttatcatggggactgaggatgcctcctccttgcctgaagccagtcaagaggcagggagcagaggcaattccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttgg

SEQ ID NO: 161707 - DNA, 4196 bp, Homo sapiens
  Payload ID: 11567
  Gene Symbol: NUTM1
  Gene Name: NUT midline carcinoma, family member 1
  Uniprot ID: Q86Y26
  ENST ID: ENST00000614490
  CDS Start-End: 552-3950
ctactgtgtgctaggtacacggcgttagaggggggtagggatggatgtggatagaatattgacgtatagaagcctgtctttgtctcaagatacacacccatttcaggagcagtgagttttcaatgcctgaagaaacaagggctccaggattcagagcccctttaccctagggaagaaagaagaggttttcttccctcccctcttttacatccagttcccctgctccatttcaaagcgttggcggtaaagaatgcatgttgagtatcaatattccgtaaagcgaaagagcgtaaagttattttatgaaactggtgaagcatgtttcagcggtcgaaccaagatttaaagttaggtccctaccgcaaattcagcgctctttcttatggtgaatgccttgagttccgtattctagttctgtgtgatctgatctttaccttcccttccttggatccctgtgcacctactggagccaggttactctgggtcctggacctgactgcctcattctggaggcttccagacagccacagttagtgcccaaacctgagaggatggcttcagatggagcatctgcattgccgggaccggatatgagcatgaaacctagtgccgccccgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggatgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcagccagaacttgcagctccacagggaactccgggacccttgggtgtggagaggagagggtctgggaaggttataaaccaggtatctctacatcaggatggccatctaggaggcgctgggcctcctgggcactgcctggtggctgataggacttcagaggctctgcccctttgttggcagggaggcttccagcctgagagcactcccagtttggatgctggacttgcagagctggctcctctgcaaggacaagggttagaaaagcaagtcctgggattgcagaaaggacaacaaacagggggtcgtggagtgcttcctcaagggaaggagcctttagcagtgccctgggaaggctcttcaggagccatgtggggagatgacagaggtacccccatggctcagagttatgatcagaatccttcccctagagcagctggggagagggacgatgtctgtctcagcccaggagtttggctgagcagtgagatggatgctgtaggcttggagctgcctgtacaaatagaggaggtcatagagagcttccaagttgagaagtgtgtaactgagtatcaggaaggctgccagggactgggctccaggggcaacatttccctgggtcctggagaaaccctagtacctggggatacggagagcagtgtgattccctgtggaggcacagttgcggcagctgccctagaaaagagaaactattgcagcttgccaggacctttgagggccaacagcccacccttgaggtccaaagaaaatcaagaacagagctgtgaaaccgtagggcatcccagtgatctgtgggcagaaggttgcttcccattgctagaaagtggtgattccacactggggtcttccaaagaaacccttccacccacatgccaaggcaatctccttatcatggggactgaggatgcctcctccttgcctgaagccagtcaagaggcagggagcagaggcaattccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttggaaaatgctc

SEQ ID NO: 161708 - DNA, 2713 bp, Homo sapiens
  Payload ID: 11568
  Gene Symbol: NYX
  Gene Name: nyctalopin
  Uniprot ID: Q9GZU5
  ENST ID: ENST00000342595
  CDS Start-End: 457-1902
tggctgcctgacttgggagatggatgggctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatgcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctctactgctggacttttcagagtctttcatatgctaacattcattgtgaatctcccaagag

SEQ ID NO: 161709 - DNA, 2297 bp, Homo sapiens
  Payload ID: 11568
  Gene Symbol: NYX
  Gene Name: nyctalopin
  Uniprot ID: Q9GZU5
  ENST ID: ENST00000378220
  CDS Start-End: 99-1544
ggctgagggagtggagggggacctcagaggagcaggaccagggagactcccaggacggtaggggtcccacggctgggtggtcctaagccactgggtggatgaaaggccgagggatgttggtcctgcttctgcatgcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctct

SEQ ID NO: 161710 - DNA, 7857 bp, Homo sapiens
  Payload ID: 11569
  Gene Symbol: NYNRIN
  Gene Name: NYN domain and retroviral integrase containing
  Uniprot ID: Q9P2P1
  ENST ID: ENST00000382554
  CDS Start-End: 319-6015
ctgggcccaaaacttgggtggaaggcagaggcctccgggaccctccccgccccctcctcccccccgccggctcccccgccctctcctccgcgcccctttaagctatccagcagacggagacagagttgatccaggaggggctggcagagtgctggagggggaaggctgggggcggagggaagggcggcaggagcccgaccggtcccacccctagctacaaccccgggcaggaagagctcgtcgcggtagcagcggtcgaaggggaccaagctccagagggcgggcgcccgagccgtgcggggagcgggcggggcagccatgctcctgtctgggggcgatcctccggcgcaggaatggttcatggtgcagacaaaatcgaagcctcgggtgcagcggcagcggctgcaagtgcagcgcatctttagggtcaagctgaacgccttccagagccgcccggacaccccctacttctggctacagctcgaggggccccgagagaacatgggcaaagccaaggaatacctgaagggcctgtgcagcccagagctgtggaaagaggttcgctacccaccgatcctgcactgtgccttccttggggcccaaggcctcttcctggactgcctctgctggagcacccttgcctacctggtgcctggcccccctggctccctgatggtgggcgggctgactgagtctttcatcatgacacagaactggctggaggagctggtggggcgactgcgctggggccctgcccctctgctgaccccccgggggatctgggaggctgaggtgacccgggcctttggggccctggtctggatccgtggtgaccagcatgcaggggacctactgcagctgcccccagcggtccaggagctgctgctgagcctggtgcgggatgctgcgggcaaggaagacatcatcgagtggctcagccgcttcggcatctctgactcccactccgatccggaggttctaatctgccctccccagcagcagaaggaagccccagccatggtgtccgtgggagagagtcctggaccctttgtggacatggggaccctccagaacaggggcccagaaaattcaaagagattatctagcctgggagccactgggtccctgatcacagcccagagcacaccgcaggaggcagcaaaccagctggtacgggtcggttccaacaaccaagatggtatggacagtgctcaagaggaagggacagtgcaagccaccagcagccaggactccacgaaccacacacaagccttgttgaagcaaaggcaggtccagaagatagaagataaactcctcttccaacctccagtatcagccctgggtgtgtgcccaccctggaaggcctggaccccggggccagcctttgggccattgtggccgggggctattgctgcaaccttctggaggatcaatgagctgcattctctacatctggcctggctcctgtcccaggcgtgcttcaatttccccttctggcagagacctctgggccccattcagttgaagctgccagggcagaatcctttgcccttaaatctggagtggaagcagaaggagctggctcctctgcctagtgcagaaagcccagctggtagaccagatggggggctgggaggagaagcagccctgcagaattgcccaaggccagagatttccccaaaagttacgagtttattggtggtccctgggagctcagatgtaaaagacaaagttagctcggatctcccacagatagggccacccttgacctctacaccccaactacaggctggaggtgagccgggggatcaagggagtatgcagttagattttaagggactggaagagggacccgctccagtgctgccaacagggcaagggaagcccgtggctcaaggggggctgacagatcagtcagtacctggagctcaaacagtgcctgaaactctcaaagtgcccatggctgcagcagtgcccaaagctgaaaatccctccagaactcaagtgccatctgcagctcccaaactgcctacatctcgaatgatgctggcagtgcacacagagcctgcagctcccgaagtgcctttggctccaacaaagccaacagctcaactgatggccacagctcaaaaaacagttgtgaatcaaccagtgttggtagctcaagtggaacccacaactccaaaaactccccaggctcagaagatgcctgtagcaaaaacatcacctgcaggtcccaaaacacccaaagctcaagccgggcctgcagctacagtttccaaagcacctgcagcttccaaagcacctgcagctcccaaagtacctgtgacccccagagtctccagagctcccaaaacacctgcagctcagaaggtgcccacggatgcagggccaaccttggatgtagccagacttctgagtgaggtccagcctacatcaagggctagtgtctccttactgaagggccaggggcaggctggaaggcagggtccccagtccagtggcaccttggccctcagcagtaagcaccagtttcagatggaggggctcctgggggcttgggagggggccccaaggcagccacctcgccacctgcaagcgaacagcacagtgaccagcttccagaggtaccacgaggccctgaatacacccttcgagctgaacctgtcaggggaacctggaaaccaggggttgcggcgagtggtcatcgatggcagcagtgtggccatggtgcatggcctgcagcacttcttctcctgccgaggaattgccatggcagtgcagtttttctggaaccggggacaccgagaggtcactgtgtttgtacccacctggcagctgaagaagaaccggagggtgagagagagccactttctgacgaagctacactcgctcaagatgctttcaatcacaccctcccagcttgagaatggcaagaagatcaccacctacgattataggttcatggtaaagctggcagaggagacagatggcatcattgtcaccaatgagcagattcacatcctgatgaatagttccaagaaactgatggtcaaagatcgcttgctgcctttcacctttgcggggaatctcttcatggtgcctgatgaccccctgggccgtgatggccccaccttggatgagtttctgaagaagccaaacaggttggacactgacattggcaacttcctgaaggtgtggaagacccttcctcccagctcagccagtgtcactgagctgagtgatgacgctgactctgggcccctggagagtctgccgaatatggaagaagtcagggaagagaaggaggagaggcaggatgaggagcagagacaggggcagggcacacagaaggcggctgaggaggacgaccttgactcttcgctggcgtcagtgttcagggtggagtgcccgtccctttcggaggagatcctgcggtgcctcagcctccatgatccccctgatggggccctggacatcgacctcctgccaggggcagcttctccctacctgggcatcccctgggatggaaaggctccctgccagcaggttcttgcccacctggcccagctcaccatccccagcaacttcaccgcactctccttcttcatgggcttcatggactcccacagggatgccatccctgactatgaagccctagtgggccccctgcacagcctcctcaagcagaagcctgactggcagtgggaccaggagcatgaggaggccttcctggccctgaagcgagccctggtgtctgccctctgcctgatggcccccaactcccagctgcccttccgcctggaggtgaccgtgagccacgtggccctgacggccatcctccatcaggagcactcagggaggaagcaccccatagcctatacctcaaaacccctcctccctgatgaggagagccagggcccccagtcagggggtgacagcccctatgctgtggcctgggccctcaagcatttttcccgctgcattggagacaccccggtggtcctggacctttcctatgcctcccggaccactgcggaccctgaggtgcgggagggccgcagggtttccaaagcttggttgatccgatggtccctcttggttcaggacaaaggcaagagggccctggaattggccctcctccagggcctgctgggggagaaccgcctgctcacccccgcggcctccatgcctcgcttcttccaggttctgccgcctttctctgacctgtccacgttcgtctgcatccacatgtcgggctactgcttctaccgtgaggatgagtggtgtgctggctttggtctctatgttctatcgcccaccagcccccctgtctccctttccttctcctgctccccttacacgccaacctatgcccacctggcagccgtggcctgcggcctggagcgctttggccagtccccactcccagtggttttcctcactcactgcaactggatcttcagcctcctgtgggagctcctgcccctctggagggctcggggcttcctctcctctgatggggctccactccctcacccaagcctgctctcctacattatatccctcacctctggcctctcatcccttccgtttatctaccgaacctcctaccggggctctctgtttgctgtgacagtggacaccctggccaagcagggtgcccaggggggtgggcagtggtggagtttgccaaaggatgtgccagcccctacagtgagtccccatgccatgggcaagaggcccaatttgctggcattacagctgagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagtccccatggcccctcaggtcgaccgccccctggtcgaacctgcagatcgaggtggtgggcccggtcaccataagtgaggagggccataagcatgtacttattgtggctgacccaaacaccaggtgggtggaggcattccccctgaagccctacacacacacggctgtggcccaggtgctgcttcagcatgtgtttgcaaggtggggtgttcctgtgaggctggaggcagcccaggggccccagtttgcccggcacgtccttgtgagctgtgggctggccctgggagcccaggtggcctccctgagtcgggacctccagttcccctgcctgacgagctcaggggcctactgggaattcaagagggccctcaaggagttcatcttcctgcatgggaagaagtgggcggcctccctgcctttgctgcacctggccttcagggcctcctccactgatgccacaccgttcaaggtcctgaccgggggtgagtcaaggctcacggagcccctgtggtgggagatgagcagcgcaaacattgaagggctcaagatggacgtcttcctgctacagctggtgggggagctgctggagctccactggagggtggctgacaaggcgagtgaaaaggccgagaacaggcgtttcaagcgggagagccaggagaaggagtggaatgtgggtgaccaggtccttttgctgtccctccccaggaatggcagcagtgccaaatgggtgggtcccttctatatcggggaccggctgagcctgtcactctataggatatggggcttcccaaccccagagaagctggggtgcatctatcccagcagtctgatgaaggcctttgccaagagtggcaccccgctgtccttcaaggtcttggagcagtgagcgggagcagcgggggtgccccctgccccagggccgtgggtttctgctgctaggcctccccctgtcccagcagtgctctcagtccactgggggccctcagttgtgccttttgtagagaacttgcttcataaagctttgctgaattgccttgaactagggaccagcatccccatggaaacatccccagtttggggtacttggagaatttgccaaaggctgtcagatatgggtccctggcagttttacactgggaaatggagtgctcctctaggctataccaggctcagtgtcttctccccaagtatcctctttccccttcacatgtaggtgtgtggtggtgtgcacacacactcacgaaagaatctatcttggccatgaaactgtggctgttgaccttggaattggaaccacagtcctttcccatacagaaaccccaaatgtgggctcctccctccaacctgttcttttggggaccctttgcccttagagctgtcacagatgacataagcctgggcaggctgtggggaggccgctgcctcctagcctcacggtcagctttctcaagccaggtgtggcctgcacagctctcagggcagggctggccatcctcccaggcctcaagggcagtgtcttggagtgggaggatggccagccacaagccaccagcttgtcagcatgggaagggcaagggggaaatgggttggcctacctcatttgactccagccaatggagacaattcctgacccctgctttgatggtgttgaccccacaggaatcaaggatcttgatgccaagtgtggcatctctatctgaagagctgcttctgttagacccaggggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaaatgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctgtccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactggagctga

SEQ ID NO: 161711 - DNA, 1759 bp, Homo sapiens
  Payload ID: 11570
  Gene Symbol: MGMT
  Gene Name: O-6-methylguanine-DNA methyltransferase
  Uniprot ID: P16455
  ENST ID: ENST00000306010
  CDS Start-End: 33-749
gtgcccctcggccccgcccccgcgccccggatatgctgggacagcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagctggagctgtctggttgtgagcagggtctgcacgaaataaagctcctgggcaaggggacgtctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctgggaacaagcgtgtctgccctttctgtttccatattttacagcaggatgagttcagacgcccgcggtcctgcacacatttgtttccttctctaacgctgcccttgctctatttttcatgtccattaaaacaggccaagtgagtgtggaaggcctggctcatgttgggccacagcccaggatggggcagtctggcaccctcaggccacagacggctgccatagccgctgtccagggccagctaaggcccatcccaggccgtccacactagaaagctggccctgccccatccccaccatgcctcccttcctggctgtgtccatggctgtgatggcattctccactcagcagttcctagcatcccacacccaggtctcactgaaagaaaggggaacaggccatggcagtcagtgcttacagaggttttctagctttgtttcctacctgccaaaaaggctaatgcaagatgcatccacttatggtctgtatcaggtgaatagaaaataaccatttgccaagatttggaaagacagagagctctctggacacgggttcgatggagcttgcacctctctgagagctgaagtcaagtctcaccctctctccatactccctggcctagtgtgctctgggcagcaggtaggaagggacagggacctctcatctcaagggctgccccaaagggccctcagggaccatgggcctgttaggaccccagcaccccagtgtcgatcctggaagtcaaaggtcacgactgtggggggccagctcatgtcactgatggcagcaggcagggtttccagcatgggcggtgcgctgctgtctgatacttcattattgtgttgtcatcctagctgtataattaactatatccaaaagccggaagggaaacctgtagctctgcatatgg

SEQ ID NO: 161712 - DNA, 1129 bp, Homo sapiens
  Payload ID: 11571
  Gene Symbol: OARD1
  Gene Name: O-acyl-ADP-ribose deacylase 1
  ENST ID: ENST00000373154
  CDS Start-End: 237-497
ctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtga

SEQ ID NO: 161713 - DNA, 1337 bp, Homo sapiens
  Payload ID: 11571
  Gene Symbol: OARD1
  Gene Name: O-acyl-ADP-ribose deacylase 1
  Uniprot ID: Q9Y530
  ENST ID: ENST00000424266
  CDS Start-End: 345-803
gagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaattt

SEQ ID NO: 161714 - DNA, 401 bp, Homo sapiens
  Payload ID: 11571
  Gene Symbol: OARD1
  Gene Name: O-acyl-ADP-ribose deacylase 1
  ENST ID: ENST00000471367
  CDS Start-End: 127-393
gggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgtgagttttggaaaccacttacctggtttgccctggctagagcaccttttaatctgttacactttaataaaatatgcgtgtaaagagggga

SEQ ID NO: 161715 - DNA, 832 bp, Homo sapiens
  Payload ID: 11571
  Gene Symbol: OARD1
  Gene Name: O-acyl-ADP-ribose deacylase 1
  ENST ID: ENST00000482515
  CDS Start-End: 338-571
agtttcgttacgcatgcgcgggcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtg

SEQ ID NO: 161716 - DNA, 829 bp, Homo sapiens
  Payload ID: 11571
  Gene Symbol: OARD1
  Gene Name: O-acyl-ADP-ribose deacylase 1
  ENST ID: ENST00000480585
  CDS Start-End: 88-348
ggttgttcttccctgctgagatggctggctgacttcaccagtcaagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttg

SEQ ID NO: 161717 - DNA, 704 bp, Homo sapiens
  Payload ID: 11571
  Gene Symbol: OARD1
  Gene Name: O-acyl-ADP-ribose deacylase 1
  ENST ID: ENST00000469104
  CDS Start-End: 214-480
accgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgtgagttttggaaaccacttacctggtttgccctggctagagcaccttttaatctgttacactttaataaaatatgcgtgtaaagaggggattcctaagaaccaaatgtttttaagattttcctccccaagaatggcctctagtttagacgtttaccatatcaaaacccaactcctgtgaaggtttttaatctcttcctcttgtatcatgaaactttcttgacgatattactgtacttctctgaaacttgaaataactctgagatgcttagtctataggttggcattcaagatcctttacttaccaa

SEQ ID NO: 161718 - DNA, 764 bp, Homo sapiens
  Payload ID: 11571
  Gene Symbol: OARD1
  Gene Name: O-acyl-ADP-ribose deacylase 1
  ENST ID: ENST00000486443
  CDS Start-End: 285-626
ctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgc

SEQ ID NO: 161719 - DNA, 717 bp, Homo sapiens
  Payload ID: 11571
  Gene Symbol: OARD1
  Gene Name: O-acyl-ADP-ribose deacylase 1
  ENST ID: ENST00000464633
  CDS Start-End: 242-475
gtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatat

SEQ ID NO: 161720 - DNA, 1515 bp, Homo sapiens
  Payload ID: 11571
  Gene Symbol: OARD1
  Gene Name: O-acyl-ADP-ribose deacylase 1
  Uniprot ID: Q9Y530
  ENST ID: ENST00000463088
  CDS Start-End: 197-655
ccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtc

SEQ ID NO: 161721 - DNA, 814 bp, Homo sapiens
  Payload ID: 11571
  Gene Symbol: OARD1
  Gene Name: O-acyl-ADP-ribose deacylase 1
  ENST ID: ENST00000488238
  CDS Start-End: 422-814
gctttcctgattgcagttttggttgagaaggttgttcttccctgctgagatggctggctgacttcaccagtcaagaggcctgcaggatgaactggtcttaagtgtgagaaagatttagctatgtgatgatgtggaggaaggtgaagtactacaaatcaagagagcataaaaacaagaacagaaatatttcagcatgtgaacagtggactaaacaggaaaaaaagcttggggccacactactttctctcaaaatgtcagacaaagaaattcttctgcagactggtggaagcttgtaaggtcaggacgcagtggctcatgcctgtaatcccaacgttttgggagaacaagaagggaggatggcttgagcccaggagttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaat

SEQ ID NO: 161722 - DNA, 1245 bp, Homo sapiens
  Payload ID: 11571
  Gene Symbol: OARD1
  Gene Name: O-acyl-ADP-ribose deacylase 1
  ENST ID: ENST00000482853
  CDS Start-End: 1-232
tatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggtgctgtttcaggtactgggaatatggcaaaagaacaaagcaaatgaaaatccctgctgtgatgatttgtggagcttgaggaactgaacaacaaataaggcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcaggtaggcacatgccattggcctgtcttcccacacccatctctctgaggactgtctttcctgcccactttctctgtctgccttatcttcatctctctgtatagaagatggtctgcaaatcctttatcccctggtgtctctttctggcccctctgtcctaatgtttgtagcagtttttctcacatcaatcatgtccatgactgcaaatcccattgctgtctctctgtctgtctggaagtgtctgactcagcaccatc

SEQ ID NO: 161723 - DNA, 3330 bp, Homo sapiens
  Payload ID: 11571
  Gene Symbol: OARD1
  Gene Name: O-acyl-ADP-ribose deacylase 1
  Uniprot ID: Q9Y530
  ENST ID: ENST00000479950
  CDS Start-End: 315-773
ggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaaagaaattaaaaattagctgggcctggtggtgcaggcctgtagttccagctactctagaggttgaggcgggaggatggcttgagcctgggaggttgaagttgcattgagctgtgattgtgccactgcactccagtgtgggcaacagagcaagaccctatctcaattaaaaaaaaaaatttggtggtggagtgggatggccacttttgtgtttttaacctccatagaagatttggatgtgcagccagctggggtctaaatattagtcctcttttcttccgaagctgcaaagaccagtcgtctattgtggtcatggtaggaaaataaagttcatggatttagccaatggttcagtatcagagctattcgggaaactagacattttcttgttttcccttacagtggtgttgagagttaaaacagccagacttgctattgattttctccctagagtgactttgggtctgtcacaggacttgctgctttcccaagtataaaagaacaactgtattttagaaggggctggttaaaacaccaggaaagtactggttaaatataatctttgtactttagactgtgttcttatcacatatcagcctgataagaggcaacagtttcaaaaaagtatttcacttttgtatttctaggtggaacagacaagttcttcatgttgttggggtaggggcagtggagggtcaagttcattatcaaacttttagattgaggcttttcttgaagcattgcttttgtccacataaagttgaagggaaaaaggaaggagagattatctaaatacacaaaattgaaagtgagagtgggggataagaaacttaaagaaacttaaaatattttgcttaactctgcaattacagatgctcctcaacttaggtctatgtctgggtaaccccatcttaagttgagttcagttgaagggtgtactgaatgtgtatggcttttgcaccgttgtaaagtccaaaaattgcaagacaaaccattgtaaattgagtaccatctgtaaaccttaacacaagtcaaaacatggattttctaggcttcctttacttttaaagagattatggttattattattatttttttcttggcgtttgagccttgattctttagacaaaacctagtctcattcaggattggctgtaagtggaattctgggacttagcaggaatgtgataaagcactttgtcatttgccgatagtagtcttgggtcaaattccgacgacttatcacacttgaagcctgaggaaaggaggcatgccctggtaatcagagtgaacacattattcctggaaacctagttagagtttggcaaacacccggaaattcacctgtgaatttttgcttccacataggactcaaacaaacctttaaaaaaaaaaaaagagagacttgacatcatcctgccattaccatcaaacaccatgtattgaatacttttaaatgattgtatatctgaacattaaactactacttttcacccgctcctctctaataaagaagctagttgcttattaa

SEQ ID NO: 161724 - DNA, 819 bp, Homo sapiens
  Payload ID: 11571
  Gene Symbol: OARD1
  Gene Name: O-acyl-ADP-ribose deacylase 1
  Uniprot ID: Q9Y530
  ENST ID: ENST00000468811
  CDS Start-End: 207-665
ctctttgccccagaagggttttgtattacgtcccaggggccgaacaaactcacattcatcgataaacgttggggaaaaaagcctattaagtggttgtacagggcaatcagaatattatatactaaggctgcctaagcatttttacttccttttcccttctcatagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttg

SEQ ID NO: 161725 - DNA, 1188 bp, Homo sapiens
  Payload ID: 11571
  Gene Symbol: OARD1
  Gene Name: O-acyl-ADP-ribose deacylase 1
  ENST ID: ENST00000628419
  CDS Start-End: 301-561
acggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagtt

SEQ ID NO: 161726 - DNA, 4417 bp, Homo sapiens
  Payload ID: 11572
  Gene Symbol: OLA1
  Gene Name: Obg-like ATPase 1
  Uniprot ID: Q9NTK5
  ENST ID: ENST00000284719
  CDS Start-End: 248-1438
ccccggccggttaggccaatgggcgggacgcgcgggcaaggcggggaggggcggggcccatggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagccttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattaaaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgtcggttgttcctaatggcaaactactttagctgggaaaattcatttcaacttattttaagcttgtaaaatacactgtggtgataaaataaaagagctgggtttga

SEQ ID NO: 161727 - DNA, 1656 bp, Homo sapiens
  Payload ID: 11572
  Gene Symbol: OLA1
  Gene Name: Obg-like ATPase 1
  Uniprot ID: Q9NTK5
  ENST ID: ENST00000344357
  CDS Start-End: 522-1238
gttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaacc

SEQ ID NO: 161728 - DNA, 2071 bp, Homo sapiens
  Payload ID: 11572
  Gene Symbol: OLA1
  Gene Name: Obg-like ATPase 1
  ENST ID: ENST00000409546
  CDS Start-End: 632-1882
agtggccaagatggggccagggcagcgggtggcttggggatgtgtggatgaatgaggcgctgtcggactaggccgcgcgtcgggagatcggcctacgcctcacgcgggaaagccctggggaaagccttctcccgacgccaggacgcccggtggcccagtccggagaggaggatggggggtggggcccactttgggtgggctgccggccacctctctgtaggccagaggacccgacaggcgctgttcctgtatctgttctttggaggcctgggagttggccaggaacaggtgtcaggacgctgagaagggaaattcctggccctcggggtcagggatcagaggctggaatactactgcaagggcagggccccagcgtggtcctaggaggtacaactctcagccagaagactgggacagttttagttcccagcttctgagacgtgagcttagcggtctttgtgatttcactttgcagtccaagggtgggagtaattctgcacgcatgatttggagacagaactagtaagggacagagaaagtttcgacttgtaaataaaaaggttccgtcgattaatttaccattagaaatagtaaccataatgtagattttggaggttgcttatgaggactgatgagccgtaccttcagtgccaaaggtgggagggacttggtggaaggaccccagtacctgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcac

SEQ ID NO: 161729 - DNA, 485 bp, Homo sapiens
  Payload ID: 11572
  Gene Symbol: OLA1
  Gene Name: Obg-like ATPase 1
  ENST ID: ENST00000429575
  CDS Start-End: 177-485
atatagctaattgaagattctcatcttgtgtgtaagcccagtttgcagcaaatgtggactaattttatatagcaggtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcatt

SEQ ID NO: 161730 - DNA, 1270 bp, Homo sapiens
  Payload ID: 11572
  Gene Symbol: OLA1
  Gene Name: Obg-like ATPase 1
  Uniprot ID: Q9NTK5
  ENST ID: ENST00000428402
  CDS Start-End: 25-861
gtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaa

SEQ ID NO: 161731 - DNA, 709 bp, Homo sapiens
  Payload ID: 11572
  Gene Symbol: OLA1
  Gene Name: Obg-like ATPase 1
  ENST ID: ENST00000427472
  CDS Start-End: 361-709
agttctcgagcctcagcctcccgagtagctggaattacaggctgcgcgcctgatggccggctaatttttttgtatttgtttttctttttagtagagacggggtttctccgtgttggccaggctggtctcgactcctggtctcaagcagtctgcccacctcggcctccccctcccaaagtgctgggattacaggcctgagccaccgtgcccggcccaacaaatattgattttagatcagtctttctgggacttctcagcaatgactcttttgacaacggatatgtttacagaactttttaaacatttttgctgaaaaaaaagtggatttagctctgtgttagttttggatcgctatatacaatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcct

SEQ ID NO: 161732 - DNA, 20432 bp, Homo sapiens
  Payload ID: 11573
  Gene Symbol: OBSCN
  Gene Name: obscurin, cytoskeletal calmodulin and titin-interacting RhoGEF
  Uniprot ID: Q5VST9
  ENST ID: ENST00000284548
  CDS Start-End: 75-19937
tgcctcccagcctgtgcccccagcctgcgtgctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagtcactgagcaagagactaaagtccccaagaaaaccgtcatcatagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgca

SEQ ID NO: 161733 - DNA, 2983 bp, Homo sapiens
  Payload ID: 11573
  Gene Symbol: OBSCN
  Gene Name: obscurin, cytoskeletal calmodulin and titin-interacting RhoGEF
  ENST ID: ENST00000366706
  CDS Start-End: 1-2577
gcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggtgaggcggccaagtgtgctcgggcctaggctttgaatggcacggagacttggaggtggacaggcccagcctcagtttcttatcatgagggtatagggggtgcaccctgggtggtcactgaggctccccagcatggctgtgaatgagctgctggtgctcacttactcgtgtgtttatttggtcactgtgtgtttctcccacatgccccgtgtgcctggcccccatgcgtaagctcagcgtgtatccgtacataaaacgtgtcacccttatcccagagggacagcctgactcagccgtgccaggcagcctcaggtgctcccagggaagaactgatggtcattagggttgtcattgagagttacagtggcattttagtctttttcttgttgtttacaacagaatacctgaaactgggtaatttataaaggaaataaa

SEQ ID NO: 161734 - DNA, 26933 bp, Homo sapiens
  Payload ID: 11573
  Gene Symbol: OBSCN
  Gene Name: obscurin, cytoskeletal calmodulin and titin-interacting RhoGEF
  ENST ID: ENST00000366707
  CDS Start-End: 75-26852
tgcctcccagcctgtgcccccagcctgcgtgctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggcggtgtttgccaaggagcagccggcgtgcagggaggtgcaggctgaggtgggggccagcgccacgctgagctgtgaggtggcccaggaccagatggaggtgacgtggtacaaggacgggaagaagttgagctccagctcgaaagtgcacgtggaggctgtgggctgtatgcggaggctggtggtgcagcaggtgggccaggcagactccggagagtacagctgtgaggccaggggacagagggtctccttccgcctggacgttgcagagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgctaaggagcagccagcacacagggaggtgcaggctgaagcaggggctagcgccacactgagctgtgaggtggcccaggcccagacagaggtgacttggtacaaggacgggaagaagctgagctccagcttgaaagtgcatgtggaggctgcaggctgtacacggaggctggtggtgcagcaggcaggccaggcagacaccggagagtatagctgtgaggctgggggccagcagctctccttccgcctgcaagtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagcccaaggcggtgtttgccaaggagcaggtggtgtttgccaaggatcagccggtgcacagggaggtgcaggctgaggcagggaccagcaccatgctgagctgcgaggtggcccaagcccagacggaggttatgtggtacaaggacgggaagaagctgagctccagctcgaaaatgcgtgtggaggccgtgggctgcacacggaggctggtggtgcaggaggcaggccaggcggacgccggggagtacagctgcgaggctgggggccagcggctctccttccatctgcatgtggctgagcccaaggtggtgtttgccaaggagcagccggcatgcagggaggtgcaggcggaggcgggggccagtgccacgctgagctgtgaggtggcccagggccagatggaggtgacatggtacaaggacgggaagaagctgagctccagctcaaaagtgcacatggaggccagcggctacacacggaggctggtagtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaggccagagaaggggccacggccacactgcactgtgaactgagcaaggtggcccctgtggagtggaggaagggacctgaaaccctccgagatggggacagacacagcctgaggcaggatgggaccaggtgtgagctgcagattcgtggcctgtctgtggcagatgccggggagtactcgtgcgtgtgtgggcaggagaggacctcagccacactcacgatcagggccctgcccgccaagttcacaaagggtctgaggaatgaagaggccacagaaggggccacggctatgttgcagtgtgagctgagcaaggtggcccctgttgagtggaggaagggacctgaaaccctcagagatggggacagatacaacctgaggcaggatgggaccagatgtgagctgcagattcatggcctgtccgtggcagacactggggagtactcatgtgtatgtggtcaggagaagacgtcggccactctcactgtcaaggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggctccagagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgagaa

SEQ ID NO: 161735 - DNA, 24060 bp, Homo sapiens
  Payload ID: 11573
  Gene Symbol: OBSCN
  Gene Name: obscurin, cytoskeletal calmodulin and titin-interacting RhoGEF
  Uniprot ID: Q5VST9
  ENST ID: ENST00000422127
  CDS Start-End: 75-23981
tgcctcccagcctgtgcccccagcctgcgtgctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggctccagagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 161736 - DNA, 1877 bp, Homo sapiens
  Payload ID: 11573
  Gene Symbol: OBSCN
  Gene Name: obscurin, cytoskeletal calmodulin and titin-interacting RhoGEF
  ENST ID: ENST00000474237
  CDS Start-End: 1-206
cagggagcagctcgtggctgcagtggaagtcactgagcaagagactaaagtccccaagaaaaccgtcatcatgtaagtgcaggcgtgttcctaaccttccttctgactgcagtgcctcctgcatgccactgacctgcctggatcatgcctgtgtggcccagccacctgcttgctgcctgtctgctcacataacatgcaccctctgactgccagcaccttacagagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgca

SEQ ID NO: 161737 - DNA, 26925 bp, Homo sapiens
  Payload ID: 11573
  Gene Symbol: OBSCN
  Gene Name: obscurin, cytoskeletal calmodulin and titin-interacting RhoGEF
  ENST ID: ENST00000570156
  CDS Start-End: 75-26846
tgcctcccagcctgtgcccccagcctgcgtgctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggcggtgtttgccaaggagcagccggcgtgcagggaggtgcaggctgaggtgggggccagcgccacgctgagctgtgaggtggcccaggaccagatggaggtgacgtggtacaaggacgggaagaagttgagctccagctcgaaagtgcacgtggaggctgtgggctgtatgcggaggctggtggtgcagcaggtgggccaggcagactccggagagtacagctgtgaggccaggggacagagggtctccttccgcctggacgttgcagagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgctaaggagcagccagcacacagggaggtgcaggctgaagcaggggctagcgccacactgagctgtgaggtggcccaggcccagacagaggtgacttggtacaaggacgggaagaagctgagctccagcttgaaagtgcatgtggaggctgcaggctgtacacggaggctggtggtgcagcaggcaggccaggcagacaccggagagtatagctgtgaggctgggggccagcagctctccttccgcctgcaagtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagcccaaggcggtgtttgccaaggagcaggtggtgtttgccaaggatcagccggtgcacagggaggtgcaggctgaggcagggaccagcaccatgctgagctgcgaggtggcccaagcccagacggaggttatgtggtacaaggacgggaagaagctgagctccagctcgaaaatgcgtgtggaggccgtgggctgcacacggaggctggtggtgcaggaggcaggccaggcggacgccggggagtacagctgcgaggctgggggccagcggctctccttccatctgcatgtggctgagcccaaggtggtgtttgccaaggagcagccggcatgcagggaggtgcaggcggaggcgggggccagtgccacgctgagctgtgaggtggcccagggccagatggaggtgacatggtacaaggacgggaagaagctgagctccagctcaaaagtgcacatggaggccagcggctacacacggaggctggtagtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaggccagagaaggggccacggccacactgcactgtgaactgagcaaggtggcccctgtggagtggaggaagggacctgaaaccctccgagatggggacagacacagcctgaggcaggatgggaccaggtgtgagctgcagattcgtggcctgtctgtggcagatgccggggagtactcgtgcgtgtgtgggcaggagaggacctcagccacactcacgatcagggccctgcccgccaagttcacaaagggtctgaggaatgaagaggccacagaaggggccacggctatgttgcagtgtgagctgagcaaggtggcccctgttgagtggaggaagggacctgaaaccctcagagatggggacagatacaacctgaggcaggatgggaccagatgtgagctgcagattcatggcctgtccgtggcagacactggggagtactcatgtgtatgtggtcaggagaagacgtcggccactctcactgtcaaggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 161738 - DNA, 4779 bp, Homo sapiens
  Payload ID: 11573
  Gene Symbol: OBSCN
  Gene Name: obscurin, cytoskeletal calmodulin and titin-interacting RhoGEF
  ENST ID: ENST00000483539
  CDS Start-End: 1-4779
cccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaggccagagaaggggccacggccacactgcactgtgaactgagcaaggtggcccctgtggagtggaggaagggacctgaaaccctccgagatggggacagacacagcctgaggcaggagaattgcttgaacccgggaggcagaggttgcagtgagccaagatcgtgccactgcactccagcctgggtaatagagcaag

SEQ ID NO: 161739 - DNA, 2274 bp, Homo sapiens
  Payload ID: 11574
  Gene Symbol: OBSL1
  Gene Name: obscurin-like 1
  ENST ID: ENST00000289656
  CDS Start-End: 299-2137
ccctgagcgccaggcttcgggcccgggaatcgccgccgccgccgccgcagagctgcagctcggggccgaggagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaa

SEQ ID NO: 161740 - DNA, 3297 bp, Homo sapiens
  Payload ID: 11574
  Gene Symbol: OBSL1
  Gene Name: obscurin-like 1
  Uniprot ID: O75147
  ENST ID: ENST00000373873
  CDS Start-End: 58-3135
ctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctttactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgta

SEQ ID NO: 161741 - DNA, 5503 bp, Homo sapiens
  Payload ID: 11574
  Gene Symbol: OBSL1
  Gene Name: obscurin-like 1
  ENST ID: ENST00000373876
  CDS Start-End: 10-5424
gccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctttactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggccgaggcagctgagggtgctgcggcctctggaggacgtgaccatcagtgaggggggcagtgccaccttccagctggagctgtcccaggaaggtgtgaccggggagtgggcccggggtggagtacagctgtatccaggacccaagtgtcacatccactcggacggccaccgtcaccgactggtactcaatggcctgggcctggccgactcaggctgtgtctccttcacagcggattccctgcgctgcgcagccagactcattgtgagagaggtcccagtgaccatcgtgcgggggccacacgacctagaggtgaccgagggcgacacagctacgttcgagtgcgagctttcccaagctttggctgatgttacctgggagaaggacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcgagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccgacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagaga

SEQ ID NO: 161742 - DNA, 5841 bp, Homo sapiens
  Payload ID: 11574
  Gene Symbol: OBSL1
  Gene Name: obscurin-like 1
  Uniprot ID: O75147
  ENST ID: ENST00000404537
  CDS Start-End: 58-5748
ctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctttactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggccgaggcagctgagggtgctgcggcctctggaggacgtgaccatcagtgaggggggcagtgccaccttccagctggagctgtcccaggaaggtgtgaccggggagtgggcccggggtggagtacagctgtatccaggacccaagtgtcacatccactcggacggccaccgtcaccgactggtactcaatggcctgggcctggccgactcaggctgtgtctccttcacagcggattccctgcgctgcgcagccagactcattgtgagagaggtcccagtgaccatcgtgcgggggccacacgacctagaggtgaccgagggcgacacagctacgttcgagtgcgagctttcccaagctttggctgatgttacctgggagaaggacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcgagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccgacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaa

SEQ ID NO: 161743 - DNA, 1571 bp, Homo sapiens
  Payload ID: 11574
  Gene Symbol: OBSL1
  Gene Name: obscurin-like 1
  ENST ID: ENST00000456147
  CDS Start-End: 1-1337
tggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaagtccatgtggattttgcattccattgcatatttccaagtcggctttgctataaacacaaatattctcca

SEQ ID NO: 161744 - DNA, 5520 bp, Homo sapiens
  Payload ID: 11574
  Gene Symbol: OBSL1
  Gene Name: obscurin-like 1
  Uniprot ID: O75147
  ENST ID: ENST00000603926
  CDS Start-End: 58-4689
ctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctttactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaagtccatgtggattttgcattccattgcatatttccaagtcggctttgctataaacacaaatattctccagaaagacttgccatgggcatccttcaggcatgtattctagggatacacatacccacttaagtagcagggatggctgtcaaacagcaccccacacctcccacccaaagctggagccctctgtttcctatgtgacctcatgcaagttaacctctttgagccaagtctccttaaaaatggggctgagaccaggtgcagtggctcacgcctataatcctaacactttgggaggccaaggcaggaggatcccttgaggccaggagttcgaggccatcctgggcaacatagcaagaacccatctccacaaaaaaaaataaaaattagccgggcatggtagttactagggaggctgaggcagaaggattgcttgaacccaggaggttgaggctatagtgagctatgatcatgtcacggcattccagcctgggtgacagcaagaccctgtctcaaattttaaaaatggggttgatccccgtctcaagtgtctctgggaacattaactgagataacatgaaaattcttacacagagcttggtgaatggttgtcatttgtgacacatctcttctaacttatttcattcaagaaatcatcacaataaa

SEQ ID NO: 161745 - DNA, 1774 bp, Homo sapiens
  Payload ID: 11574
  Gene Symbol: OBSL1
  Gene Name: obscurin-like 1
  ENST ID: ENST00000604031
  CDS Start-End: 1-1238
aggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaagtccatgtggattttgcattccattgcatatttccaagtcggctttgctataaacacaaatattctccagaaagacttgccatgggcatccttcaggcatgtattctagggatacacatacccacttaagtagcagggatggctgtcaaacagcaccccacacctcccacccaaagctggagccctctgtttcctatgtgacctcatgcaagttaacctctttgagccaagtctccttaaaaatggggctgagaccaggtgcagtggctcacgcctataatcctaacactttgggaggccaaggcaggaggatcccttgaggccaggagttcgaggccatcctgggcaacatagcaagaacccatctccac

SEQ ID NO: 161746 - DNA, 6438 bp, Homo sapiens
  Payload ID: 11575
  Gene Symbol: OCLN
  Gene Name: occludin
  Uniprot ID: Q16625
  ENST ID: ENST00000355237
  CDS Start-End: 437-2005
gcctctctccatcagacaccccaaggttccatccgaagcaggcggagcaccgaacgcaccccggggtggtcagggacccccatccgtgctgccccctaggagcccgcgcctctcctctgcgccccgcctctcgggccgcaacgtcgcgcggttcctttaacagcgcgctggcagggtgtgggaagcaggaccgcgtcctcccgccccctcccatccgagtttcaggtgaattggtcaccgagggaggaggccgacacaccacacctacactcccgcgtccacctctccctccctgcttcctctggcggaggcggcaggaaccgagagccaggtccagagcgccgaggagccggtctaggacgcagcagattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacaaagttttggttgctttaacatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaataataaagatcatgtaaaagtaacaaatgtgtgaaatttaaagattgtaaatatatatttacttttttaagatcaaagtttaaaccccgtggttagaattttgtgtgtttttaaatactttttatctttttgcatgccttttttaaaaaaccaactagaacttttcattatatcagaatatctgattacatttataattcaattgtgacttgaactgtatcttacaggaatgttcaatttctatacatattttataaggtattaaacctggtgttttctttccataataacctgtttgatgttattagtgctgttaacatacagcaatggaaaaccacactcaggagttgtatctgttgttgtttatactcctttggatgctgtgctggttagtcgtttcccattcctttggctgtaagaatgctgatatgtctgggaatagaatgctataccacgaaataccaaataatttcaaatggtgcccttaaattgtatcacttttttaaaaattcagattcttattagtaaaattagttgatagcactgtgctgaccaagttgattgtgatcatcccagcttagacttttctaaaaacttttttttagaataatctataaactgaactttagtatgcatttcagatatttaggtatataatttttttttttttttgagacagagtctcactctcacccaggctggaatgcagtggtgctatcttggctcactgcaacctccacctcccgggttcaagcaattctcctgcctcagcctctcgagtagttgagactacaggtgcccatcaccatgcgtggctaatttttgtatttttaatagagacggggttttaccatagtggccaggttggtcttgaactcctgaccttgtggtctgcctgcctcggcctcccaaagtgctgggattacaggcgtgagccaccatgcctggcctaagtgtgtgtgtgtgtgtgtgtgtgtatttttttttttttttttttgagatggagttttgctcttgttgaacaggctggagtgcaatgtcgcgatctcagctcaccacaacctccgcctcccaggttcaaacaattctcctgcctcggcctcccgagtagctgggattacaggcatgcgccaccacacctggctaattttttttttgtatttttagtagagatggggtttctccatgttggtcaggctggtctcgaactcctgacctcaggtgatccatccacctcggcctcccaaagtgctgggattagaggcgtgagccactgtgcccggcctataatttttgatagatgattttgaattattttccagagataaaattttaaatgtttccattatatcactgatttatttctgcaaattgaataaattcttaattttctgcatgcacataatacaaaaggtattttcatagttttggatttataccaaatgaaaaggattctcttgatgagcacctttaactgatttttctgttaaagttttaacaatttgttcttggaagtcagttcgtgaaggcaagtttgtcagtattttcacaaaactattcagctgaatccagaaagtgaaacagcaagaatttgcattgtaaaattgtgttataaaattggactttgaaatttcaaaaataagaaaaattttcatgtgtatttatactaaataccgttttaggaaactaggatcagggtgtttctgttggcgttggcattaactagctggatgtaaatttgaaaagccactcaagcagcttcctagtctagaaagtcagaggtttagattagatttccgacatcccttccatttctgacctgtagttcttgtctggaattctgctttgttataaactattgttctaaggagtttgttgtgatagcacatagttcattttgtaaagattccctgcgtataaagtgatgccctacatatgtgattttgtattaaaagtatataggatcattattttattttgaaaaatttaaatacagaaaagtataaaatataagtaccatccgcccagaaataacatgtgttaatgttttgtcatatgtgctttatattttttgaaataaagtgaagtcaactagtatttatagtaaataagttacatacacataagtacatatatgatatttaatcctcacaacgatcttttgacatgtgaccatttcttattcttcttttatagacaaggaactaatgatatgatagattaactggctgttgtcacactagcaagtggcaaaacaagggattaggatcttagtctcttcaactgttagattctatacttccatcctgtgttgactttgttaatggattggataatgtgagatcactctgatgtaaataaagtatcctatattaatttcgagtgcattttaagtacttgtaacataaatgcttcctgtgaaatatctgtaaagacctgaatgggtacatgtgtgtaaagaagaatcagggcagaaaagtgcttttatcatggctccggggaccttagcttcagttggtgttgtgagaattcctcacacaaggacattctccttgcttcagcatcaggatggaagtgtttctcatctggactttttcaaagactcagctggaggaatcagaattcataatttcctggcagctcatgattctgctacactacaccatgccatctcttgtgtgaaaggacagatttgatggaggactatgtcatccctcatgcgtttcttattgtctacatttattctaatgggaagaagtgagcaaaaacacctcaataatttgggtagtttttagaaaaccttgttagtaaattagaatagtgccactttggcattatgagaaagaagcatggatacataactagggttttgtgtatgactacaacgaaatgcagaatggtgtctccaaaaggtttccaattgctgccacaagaactgcttggtattgcctacatgtgttgtcctatttttgctttgcccttctgcagttacttgctgtgggaccttggagaaattaacttagcctctctgtacttcagttttttgtatttgtaaaatatatttgtaataatctcatagttaagaaggtagttaatgtgtgactcagtccttgtctaaaagtaaatatgcctagctacccccatcttccaaagccagaaggtgaaactttaacaagttttctaaaagcaaattgtgttttttaaaagtgcatgtgtcatccaatcccatatgattgatctgtgctgggtgcagccttagaatgtaaattcttttgaattctaggcagagaatgcaggattggcattctaaatatttgtacatgataaacaaatgcttctttaggttagagcaaatagtttacttatcaagatcacaattgttagatactgttgtcaattacagaggttttagatgaggctttctggaatgatttagtttccctgtaagggagcctgtctattggaatagacaggttcacttctcccagtctttcaagttgcatgctttttatatctgattccactggctgagctgattgtgaatgtcctaaccctgttgattgtgtctggccactcatgggcaaagaacagattatccattctttatagttgtcttttagttttacaagttgaaaaaacatctgagtaggttagataatttattctaccactttgtaaatgattagaatatgtcagtcataatcatgccaagagattatggatttatgcatattttgttttgctgtagtaccattcctagttgaatcttaacatccatgtctaaaatctatacagaacaaatattacagttgggaaaactg

SEQ ID NO: 161747 - DNA, 1748 bp, Homo sapiens
  Payload ID: 11575
  Gene Symbol: OCLN
  Gene Name: occludin
  Uniprot ID: Q16625
  ENST ID: ENST00000396442
  CDS Start-End: 180-1748
agtccccggctgagcgctggcggtcggtgcggcgtcaggtgcgcccgccaggtgagcgcgctccctggcaccgttggcccccggagggtcgggcccagttgcggcgagcggattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatag

SEQ ID NO: 161748 - DNA, 5391 bp, Homo sapiens
  Payload ID: 11575
  Gene Symbol: OCLN
  Gene Name: occludin
  Uniprot ID: Q16625
  ENST ID: ENST00000538151
  CDS Start-End: 143-958
attggtttatcttggaagctaaagggcattgctcatcctgaagatcagctgaccattgacaatcagccatgtcatccaggcctcttgaaagtccacctccttacaggcctgatgaattgccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacaaagttttggttgctttaacatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaataataaagatcatgtaaaagtaacaaatgtgtgaaatttaaagattgtaaatatatatttacttttttaagatcaaagtttaaaccccgtggttagaattttgtgtgtttttaaatactttttatctttttgcatgccttttttaaaaaaccaactagaacttttcattatatcagaatatctgattacatttataattcaattgtgacttgaactgtatcttacaggaatgttcaatttctatacatattttataaggtattaaacctggtgttttctttccataataacctgtttgatgttattagtgctgttaacatacagcaatggaaaaccacactcaggagttgtatctgttgttgtttatactcctttggatgctgtgctggttagtcgtttcccattcctttggctgtaagaatgctgatatgtctgggaatagaatgctataccacgaaataccaaataatttcaaatggtgcccttaaattgtatcacttttttaaaaattcagattcttattagtaaaattagttgatagcactgtgctgaccaagttgattgtgatcatcccagcttagacttttctaaaaacttttttttagaataatctataaactgaactttagtatgcatttcagatatttaggtatataatttttttttttttttgagacagagtctcactctcacccaggctggaatgcagtggtgctatcttggctcactgcaacctccacctcccgggttcaagcaattctcctgcctcagcctctcgagtagttgagactacaggtgcccatcaccatgcgtggctaatttttgtatttttaatagagacggggttttaccatagtggccaggttggtcttgaactcctgaccttgtggtctgcctgcctcggcctcccaaagtgctgggattacaggcgtgagccaccatgcctggcctaagtgtgtgtgtgtgtgtgtgtgtgtatttttttttttttttttttgagatggagttttgctcttgttgaacaggctggagtgcaatgtcgcgatctcagctcaccacaacctccgcctcccaggttcaaacaattctcctgcctcggcctcccgagtagctgggattacaggcatgcgccaccacacctggctaattttttttttgtatttttagtagagatggggtttctccatgttggtcaggctggtctcgaactcctgacctcaggtgatccatccacctcggcctcccaaagtgctgggattagaggcgtgagccactgtgcccggcctataatttttgatagatgattttgaattattttccagagataaaattttaaatgtttccattatatcactgatttatttctgcaaattgaataaattcttaattttctgcatgcacataatacaaaaggtattttcatagttttggatttataccaaatgaaaaggattctcttgatgagcacctttaactgatttttctgttaaagttttaacaatttgttcttggaagtcagttcgtgaaggcaagtttgtcagtattttcacaaaactattcagctgaatccagaaagtgaaacagcaagaatttgcattgtaaaattgtgttataaaattggactttgaaatttcaaaaataagaaaaattttcatgtgtatttatactaaataccgttttaggaaactaggatcagggtgtttctgttggcgttggcattaactagctggatgtaaatttgaaaagccactcaagcagcttcctagtctagaaagtcagaggtttagattagatttccgacatcccttccatttctgacctgtagttcttgtctggaattctgctttgttataaactattgttctaaggagtttgttgtgatagcacatagttcattttgtaaagattccctgcgtataaagtgatgccctacatatgtgattttgtattaaaagtatataggatcattattttattttgaaaaatttaaatacagaaaagtataaaatataagtaccatccgcccagaaataacatgtgttaatgttttgtcatatgtgctttatattttttgaaataaagtgaagtcaactagtatttatagtaaataagttacatacacataagtacatatatgatatttaatcctcacaacgatcttttgacatgtgaccatttcttattcttcttttatagacaaggaactaatgatatgatagattaactggctgttgtcacactagcaagtggcaaaacaagggattaggatcttagtctcttcaactgttagattctatacttccatcctgtgttgactttgttaatggattggataatgtgagatcactctgatgtaaataaagtatcctatattaatttcgagtgcattttaagtacttgtaacataaatgcttcctgtgaaatatctgtaaagacctgaatgggtacatgtgtgtaaagaagaatcagggcagaaaagtgcttttatcatggctccggggaccttagcttcagttggtgttgtgagaattcctcacacaaggacattctccttgcttcagcatcaggatggaagtgtttctcatctggactttttcaaagactcagctggaggaatcagaattcataatttcctggcagctcatgattctgctacactacaccatgccatctcttgtgtgaaaggacagatttgatggaggactatgtcatccctcatgcgtttcttattgtctacatttattctaatgggaagaagtgagcaaaaacacctcaataatttgggtagtttttagaaaaccttgttagtaaattagaatagtgccactttggcattatgagaaagaagcatggatacataactagggttttgtgtatgactacaacgaaatgcagaatggtgtctccaaaaggtttccaattgctgccacaagaactgcttggtattgcctacatgtgttgtcctatttttgctttgcccttctgcagttacttgctgtgggaccttggagaaattaacttagcctctctgtacttcagttttttgtatttgtaaaatatatttgtaataatctcatagttaagaaggtagttaatgtgtgactcagtccttgtctaaaagtaaatatgcctagctacccccatcttccaaagccagaaggtgaaactttaacaagttttctaaaagcaaattgtgttttttaaaagtgcatgtgtcatccaatcccatatgattgatctgtgctgggtgcagccttagaatgtaaattcttttgaattctaggcagagaatgcaggattggcattctaaatatttgtacatgataaacaaatgcttctttaggttagagcaaatagtttacttatcaagatcacaattgttagatactgttgtcaattacagaggttttagatgaggctttctggaatgatttagtttccctgtaagggagcctgtctattggaatagacaggttcacttctcccagtctttcaagttgcatgctttttatatctgattccactggctgagctgattgtgaatgtcctaaccctgttgattgtgtctggccactcatgggcaaagaacagattatccattctttatagttgtcttttagttttacaagttgaaaaaacatctgagtaggttagataatttattctaccactttgtaaatgattagaatatgtcagtcataatcatgccaagagattatggatttatgcatattttgttttgctgtagtaccattcctagttgaatcttaacatccatgtctaaaatctatacagaacaaatattacagttgggaaaactg

SEQ ID NO: 161749 - DNA, 4995 bp, Homo sapiens
  Payload ID: 11575
  Gene Symbol: OCLN
  Gene Name: occludin
  ENST ID: ENST00000615870
  CDS Start-End: 437-2005
gcctctctccatcagacaccccaaggttccatccgaagcaggcggagcaccgaacgcaccccggggtggtcagggacccccatccgtgctgccccctaggagcccgcgcctctcctctgcgccccgcctctcgggccgcaacatcgcgcggttcctttaacagcgcgctggcagggtgtgggaagcaggaccgcgtcctcccgccccctcccatccgagtttcaggtgaattggtcaccgagggaggaggccgacacaccacacctacactcccgcgtccacctctccctccctgcttcctctggcggaggcggcaggaaccgagagccaggtccagagcgccgaggagccggtctaggacgcagcagattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaacagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacagttttggttgctttaatatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaataataaagatcatgtaaaagtaacaaatgtgtgaaatttaaagattgtaaatatatatttacttttttaagatcaaagtttaaacccggtggttagaattttgtgtgtttttaaatactttttatctttttgcatgcctttttttaaaaaccaactagaacttttcattatatcagaatatctgattacatttataattcaattgtgacttgaactgtatcttacaggaatgttcaatttctatacatattttataaggtattaaacctggtgttttctttccataataacctgtttgatgttattagtgctgttaacacacagcaatggaaaaccacactcaggagttgtatctgttgttgtttatactcctttggatgctgtgctggttagtcgtttcccattcctttggctgtaagaatgctgatatgtctgggaatagaatgctataccacgaaataccaaataatttcaaatggtgcccttaaattgtatcacttttttaaaaattcagattcttattagtaaaattacttgatagcactgtgctgaccaagttgattgtgatcatcccagcttagacttttctaaaaacttttttttagaataatctataaactgaactttagtatgcatttcagatatttaggtatataatttttttttttttttgagacagagtctcactctcacccaggctggaatgcagtggcgctatcttggctcactgcaacctccacctcccgggttcaagcaattctcctgcctcagcctctcgagtagttgagactacaggtacccatcaccatgcctggctaatttttgtatttttaatagagacggggttttaccatattggccaggttggtcttgaactcctgaccttgtggtctgcctgcctcggcctcccaaagtgctgggattacaggcgtgagccaccatgcctggcctaagtgtgtgtgtgtgtgtgtgtgtgtattttttttttttttttttttttttgagatggagttttgctcttgttgaacaggctggagtgcaatgtcgcgatctcagctcaccacaacctccgcctcccaggttcaaacaattctcctgcctcggcctcccgagtagctgggattacaggcatgcgccaccacacctggctaatttttttttgtatttttagtagagatggggtttctccacgttggtcaggctggtctcgaactcctgacctcaggtgatccatccacctcggcctcccaaagtgctgggattagaggcgtgagccactgcgcccggcctataatttttgatagatgattttggattattttccagagataaaattttaaatgtttccattatatcactgatttatttctgcaaattgaataaattcttaattttctgcatgcacataatacaaaaggtattttcatagttttggatttataccaaatgaaaaggactctcttgatgagcacctttaactgatttttctgttaaagttttaacaatttgttcttggaagtcagttcgtgaaggcaagtttgtcagtattttcacaaaactattcagctgaatccagaaagtgaaacagcaagaatttgcattgtaaaattgtgttataaaattggactttgaaatttcaaaaataagaaaaattttcatgtgtatttatactaaataccgttttaggaaactaggatcagggtgtttctgttggcgttggcattaactagctggatgtaaatttgaaaagccactcaagcagcttcctagtctagaaagtcagaggtttagattagatttccgacatcccttccatttctgacctgtagttcttgtctggaattctgctttgttataaactattgttctaaggagtttgttgtgatagcacatagttcattttgtaaagattccctgcgtataaagtgatgccctacatatgtgattttgtattaaaagtatataggatcattattttattttgaaaaatttaaatacagaaaagtataaaatataagtaccatccgcccagaaataacatgtgttaatgttttgtcatatgtgctttatattttttgaaataaagtgaagtcaactagtatttatagtaaataagttacatacacataagtacatatatgatatttaatcctcacaacgatcttttgacatgtgaccatttcttattcttcttttatagacaaggaactaatgatatgatagattaactggctgttgtcacactagcaagtggcaaaacaagggattaggatcttagtctcttcaactgttagattctatacttccatcctgtgttgactttgttaatggattggataatgtgagatcactctgatgtaaataaagtatcctatattaa

SEQ ID NO: 161750 - DNA, 1654 bp, Homo sapiens
  Payload ID: 11575
  Gene Symbol: OCLN
  Gene Name: occludin
  ENST ID: ENST00000620655
  CDS Start-End: 45-1613
ggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaacagcaaattgtcacacatcaagaagatggttggagactatgatagacagaaaacatagaaggctgatgccaagttgtttgagaaattaagtatctgaca

SEQ ID NO: 161751 - DNA, 1748 bp, Homo sapiens
  Payload ID: 11575
  Gene Symbol: OCLN
  Gene Name: occludin
  ENST ID: ENST00000617110
  CDS Start-End: 180-1748
agtccccggctgagcgctggcggtcggtgcggcgtcaggtgcgcccgccaggtgagcgcgctccctggcaccgttggcccccggagggtcgggcccagttgcggcgagcggattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaacagcaaattgtcacacatcaagaagatggttggagactatgatagacagaaaacatag

SEQ ID NO: 161752 - DNA, 1223 bp, Homo sapiens
  Payload ID: 11575
  Gene Symbol: OCLN
  Gene Name: occludin
  ENST ID: ENST00000613193
  CDS Start-End: 45-437
ggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaacagcaaattgtcacacatcaagaagatggttggagactatgatagacagaaaacatagaaggctgatgccaagttgtttgagaaattaagtatctgaca

SEQ ID NO: 161753 - DNA, 1133 bp, Homo sapiens
  Payload ID: 11576
  Gene Symbol: OCEL1
  Gene Name: occludin/ELL domain containing 1
  Uniprot ID: Q9H607
  ENST ID: ENST00000215061
  CDS Start-End: 45-839
agccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaccta

SEQ ID NO: 161754 - DNA, 878 bp, Homo sapiens
  Payload ID: 11576
  Gene Symbol: OCEL1
  Gene Name: occludin/ELL domain containing 1
  ENST ID: ENST00000600232
  CDS Start-End: 1-733
caacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatgctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaccta

SEQ ID NO: 161755 - DNA, 348 bp, Homo sapiens
  Payload ID: 11576
  Gene Symbol: OCEL1
  Gene Name: occludin/ELL domain containing 1
  ENST ID: ENST00000600826
  CDS Start-End: 1-207
aaggaggcccaagttgcagcccgggtttggagggagtttgagatgaagcgaatggatcctggcttcctggacaagcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagaca

SEQ ID NO: 161756 - DNA, 752 bp, Homo sapiens
  Payload ID: 11576
  Gene Symbol: OCEL1
  Gene Name: occludin/ELL domain containing 1
  ENST ID: ENST00000598172
  CDS Start-End: 1-254
gcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatgaatctcgctctgtcacccaggcgggagtgcagtggtatgatctcagctcactgcaacctcagcgtcccgggttcaagcggttctcctgcctcagctgggatcacaggcgcccaccaccgtgcctggcaaatttttgtatttgtagtagagatggggtttcaccatgttggccaggctggtctcgaactcctgacctcaagtgatccgcccacctcggcctcccagactgctgggattacaggcatgagccaccttgcccggctcacccggtcgcctgtgcccagtttcaaggaga

SEQ ID NO: 161757 - DNA, 1044 bp, Homo sapiens
  Payload ID: 11576
  Gene Symbol: OCEL1
  Gene Name: occludin/ELL domain containing 1
  ENST ID: ENST00000597836
  CDS Start-End: 178-804
gctcttcggccgagctgcccgcgcgtcctttctccgtgcgcgtcgtcaggcgtgtcctctccgcgtgtccacccacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccc

SEQ ID NO: 161758 - DNA, 376 bp, Homo sapiens
  Payload ID: 11576
  Gene Symbol: OCEL1
  Gene Name: occludin/ELL domain containing 1
  ENST ID: ENST00000595573
  CDS Start-End: 1-287
agaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagaca

SEQ ID NO: 161759 - DNA, 942 bp, Homo sapiens
  Payload ID: 11576
  Gene Symbol: OCEL1
  Gene Name: occludin/ELL domain containing 1
  ENST ID: ENST00000601529
  CDS Start-End: 24-521
cagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagctaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagaca

SEQ ID NO: 161760 - DNA, 1341 bp, Homo sapiens
  Payload ID: 11576
  Gene Symbol: OCEL1
  Gene Name: occludin/ELL domain containing 1
  ENST ID: ENST00000598068
  CDS Start-End: 1-739
caggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggcgggagtgcagtggtatgatctcagctcactgcaacctcagcgtcccgggttcaagcggttctcctgcctcagctgggatcacaggcgcccaccaccgtgcctggcaaatttttgtatttgtagtagagatggggtttcaccatgttggccaggctggtctcgaactcctgacctcaagtgatccgcccacctcggcctcccagactgctgggattacaggcatgagccaccttgcccggctcacccggtcgcctgtgcccagtttcaaggagagaaaattgaggctcggagaatgaaaggcagagagttaagcagcttgaaggccacagggcagactgctgcaaagacttccgggtctcgccctgcctaggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagaca

SEQ ID NO: 161761 - DNA, 421 bp, Homo sapiens
  Payload ID: 11576
  Gene Symbol: OCEL1
  Gene Name: occludin/ELL domain containing 1
  ENST ID: ENST00000599286
  CDS Start-End: 1-159
cgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagctaaggaggcccaagttgcagcccgggtttggagggagtttgagatgaagcgaatgctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacct

SEQ ID NO: 161762 - DNA, 1414 bp, Homo sapiens
  Payload ID: 11577
  Gene Symbol: OCIAD1
  Gene Name: OCIA domain containing 1
  Uniprot ID: Q9NX40
  ENST ID: ENST00000264312
  CDS Start-End: 191-928
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaa

SEQ ID NO: 161763 - DNA, 1594 bp, Homo sapiens
  Payload ID: 11577
  Gene Symbol: OCIAD1
  Gene Name: OCIA domain containing 1
  Uniprot ID: Q9NX40
  ENST ID: ENST00000381473
  CDS Start-End: 419-1156
ttttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttc

SEQ ID NO: 161764 - DNA, 1306 bp, Homo sapiens
  Payload ID: 11577
  Gene Symbol: OCIAD1
  Gene Name: OCIA domain containing 1
  Uniprot ID: Q9NX40
  ENST ID: ENST00000396448
  CDS Start-End: 191-754
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaactcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaa

SEQ ID NO: 161765 - DNA, 1756 bp, Homo sapiens
  Payload ID: 11577
  Gene Symbol: OCIAD1
  Gene Name: OCIA domain containing 1
  Uniprot ID: Q9NX40
  ENST ID: ENST00000444354
  CDS Start-End: 148-732
tcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaatt

SEQ ID NO: 161766 - DNA, 1915 bp, Homo sapiens
  Payload ID: 11577
  Gene Symbol: OCIAD1
  Gene Name: OCIA domain containing 1
  Uniprot ID: Q9NX40
  ENST ID: ENST00000425583
  CDS Start-End: 276-860
tcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcaca

SEQ ID NO: 161767 - DNA, 495 bp, Homo sapiens
  Payload ID: 11577
  Gene Symbol: OCIAD1
  Gene Name: OCIA domain containing 1
  ENST ID: ENST00000509246
  CDS Start-End: 137-495
ccgcggtaccttgcacttttctccctccctgccccctctcgagtccaccctccgggccttctgcccctgatcgcttggttttccttgcagtcgcctgctgctgtcgtcgggagctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccac

SEQ ID NO: 161768 - DNA, 582 bp, Homo sapiens
  Payload ID: 11577
  Gene Symbol: OCIAD1
  Gene Name: OCIA domain containing 1
  ENST ID: ENST00000507210
  CDS Start-End: 292-582
agtgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaact

SEQ ID NO: 161769 - DNA, 577 bp, Homo sapiens
  Payload ID: 11577
  Gene Symbol: OCIAD1
  Gene Name: OCIA domain containing 1
  ENST ID: ENST00000513641
  CDS Start-End: 280-420
gcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatagatggggtttcaccgtgttaaccaggatggtctccatctcctgaccttgtgatccacctgcctcggcctcccaaagtgctgggattacagacctgtgcctttggctgcaacaagtatgttgattactcaaggattaattagtaaaggaatactttcaa

SEQ ID NO: 161770 - DNA, 441 bp, Homo sapiens
  Payload ID: 11577
  Gene Symbol: OCIAD1
  Gene Name: OCIA domain containing 1
  ENST ID: ENST00000511662
  CDS Start-End: 355-441
agtgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagag

SEQ ID NO: 161771 - DNA, 538 bp, Homo sapiens
  Payload ID: 11577
  Gene Symbol: OCIAD1
  Gene Name: OCIA domain containing 1
  ENST ID: ENST00000509664
  CDS Start-End: 320-538
gctggctctcagacccgcagtgaggtctgacgtcatttcctgcctcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatat

SEQ ID NO: 161772 - DNA, 1423 bp, Homo sapiens
  Payload ID: 11577
  Gene Symbol: OCIAD1
  Gene Name: OCIA domain containing 1
  Uniprot ID: Q9NX40
  ENST ID: ENST00000508293
  CDS Start-End: 232-969
ctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggtgggagacggacactgggtggaggatggagtgcggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgt

SEQ ID NO: 161773 - DNA, 555 bp, Homo sapiens
  Payload ID: 11577
  Gene Symbol: OCIAD1
  Gene Name: OCIA domain containing 1
  ENST ID: ENST00000505922
  CDS Start-End: 50-555
gctggctctcagacccgcagtgaggtctgacgtcatttcctgccgaaagatgaatgggagggctgattttcgagagccgaatgcagaggttccaagaccaattccccctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaa

SEQ ID NO: 161774 - DNA, 552 bp, Homo sapiens
  Payload ID: 11577
  Gene Symbol: OCIAD1
  Gene Name: OCIA domain containing 1
  ENST ID: ENST00000504654
  CDS Start-End: 222-552
agatgaactgaggcctctgctagcaatcatgtcagtaagctgccttggaagtggatactgcagccccaagagagccttcagatgactgtaaccccagcctacctcttaatcacagcctggtgagaaaaaccgtagcctcagagagatcacggtaccctgccagaggttgtagaacttgttggaaacttggatcaagagggtgtgacaaataaccaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttg

SEQ ID NO: 161775 - DNA, 653 bp, Homo sapiens
  Payload ID: 11577
  Gene Symbol: OCIAD1
  Gene Name: OCIA domain containing 1
  ENST ID: ENST00000514981
  CDS Start-End: 276-611
tttcctgccgtaagtatacagtgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctggg

SEQ ID NO: 161776 - DNA, 1288 bp, Homo sapiens
  Payload ID: 11577
  Gene Symbol: OCIAD1
  Gene Name: OCIA domain containing 1
  Uniprot ID: Q9NX40
  ENST ID: ENST00000513391
  CDS Start-End: 63-800
ttttcctgcctgtgagggtggacagatcgcgctcgggtctcggcctcctgagtgccggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaaca

SEQ ID NO: 161777 - DNA, 1204 bp, Homo sapiens
  Payload ID: 11577
  Gene Symbol: OCIAD1
  Gene Name: OCIA domain containing 1
  ENST ID: ENST00000509122
  CDS Start-End: 61-717
attcctaggctgctggctctcagacccgcagtgaggtctgacgtcatttcctgccgaaagatgaatgggagggctgattttcgagagccgaatgcagaggttccaagaccaattccccctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaac

SEQ ID NO: 161778 - DNA, 348 bp, Homo sapiens
  Payload ID: 11577
  Gene Symbol: OCIAD1
  Gene Name: OCIA domain containing 1
  ENST ID: ENST00000508996
  CDS Start-End: 108-348
agtgcctccgggtcgcggtcattttgagcccctgtctggatgacttcttgcggctgttctacccctccccctccccgcgtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatac

SEQ ID NO: 161779 - DNA, 720 bp, Homo sapiens
  Payload ID: 11577
  Gene Symbol: OCIAD1
  Gene Name: OCIA domain containing 1
  ENST ID: ENST00000503016
  CDS Start-End: 183-720
ctctcgagtccaccctccgggccttctgcccctgatcgcttggttttccttgcagtcgcctgctgctgtcgtcgggagacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaag

SEQ ID NO: 161780 - DNA, 432 bp, Homo sapiens
  Payload ID: 11577
  Gene Symbol: OCIAD1
  Gene Name: OCIA domain containing 1
  ENST ID: ENST00000509963
  CDS Start-End: 142-432
gttctacccctccccctccccgcggtaccttgcacttttctccctccctgccccctctcgagtccaccctccgggccttctgcccctgatcgcttggttttccttgcagtcgcctgctgctgtcgtcgggaggtgggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaact

SEQ ID NO: 161781 - DNA, 582 bp, Homo sapiens
  Payload ID: 11577
  Gene Symbol: OCIAD1
  Gene Name: OCIA domain containing 1
  ENST ID: ENST00000510824
  CDS Start-End: 274-582
gcagtcgcctgctgctgtcgtcgggaggaaagatgaatgggagggctgattttcgagagccgaatgcagaggttccaagaccaattccccgtaactatctattaagtatttataattagaagcacttcctatgtaaaggaattttcactgccttgagtaacagtggcagacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcct

SEQ ID NO: 161782 - DNA, 594 bp, Homo sapiens
  Payload ID: 11577
  Gene Symbol: OCIAD1
  Gene Name: OCIA domain containing 1
  ENST ID: ENST00000512236
  CDS Start-End: 82-594
gcctccgggtcgcggtcattttgagcccctgtctggatgacttcttgcggctgttctacccctccccctccccgcggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatct

SEQ ID NO: 161783 - DNA, 563 bp, Homo sapiens
  Payload ID: 11577
  Gene Symbol: OCIAD1
  Gene Name: OCIA domain containing 1
  ENST ID: ENST00000509164
  CDS Start-End: 323-563
cattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatac

SEQ ID NO: 161784 - DNA, 571 bp, Homo sapiens
  Payload ID: 11577
  Gene Symbol: OCIAD1
  Gene Name: OCIA domain containing 1
  ENST ID: ENST00000506801
  CDS Start-End: 121-543
ttttctccctccctgccccctctcgagtccaccctccgggccttctgcccctgatcgcttggttttccttgcagtcgcctgctgctgtcgtcgggagctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtgaaaaattacatcattggacatgaaggagt

SEQ ID NO: 161785 - DNA, 688 bp, Homo sapiens
  Payload ID: 11577
  Gene Symbol: OCIAD1
  Gene Name: OCIA domain containing 1
  ENST ID: ENST00000511102
  CDS Start-End: 172-688
ttttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctc

SEQ ID NO: 161786 - DNA, 636 bp, Homo sapiens
  Payload ID: 11578
  Gene Symbol: OCIAD2
  Gene Name: OCIA domain containing 2
  Uniprot ID: Q56VL3
  ENST ID: ENST00000273860
  CDS Start-End: 194-493
ggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaa

SEQ ID NO: 161787 - DNA, 611 bp, Homo sapiens
  Payload ID: 11578
  Gene Symbol: OCIAD2
  Gene Name: OCIA domain containing 2
  ENST ID: ENST00000381464
  CDS Start-End: 186-450
cgggaagctggagcgggccggcggtgcagtcacgggggagcgaggcctgctgggcttggcaacgagggactcggcctcggaggcgacccagaccacacagtgattctcttctaccttccttagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaata

SEQ ID NO: 161788 - DNA, 1163 bp, Homo sapiens
  Payload ID: 11578
  Gene Symbol: OCIAD2
  Gene Name: OCIA domain containing 2
  Uniprot ID: Q56VL3
  ENST ID: ENST00000508632
  CDS Start-End: 234-698
aggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaacattgtgtctgtcactcactgaaatgtattccgtggaaggctttcaagtgaactaagcgttacatgtttttctgctctttaagaacatgtcggggcatggcgcagtggctcatgcctgtaatcccagtactttgggaggccgaggcaggcagatcatttgaggtcaggagttcatgaccagcttggccaacatggtgaaaccccatctctgctaaaaatataaaaattagccaggcgtggtggcacatgcctgtaatcccagctactgagagggaggctgaggcaggagaatcacttgaacccaggaggcgaaagttgcagcgagcagagattgtgccactgcactccagcctgggtgccaga

SEQ ID NO: 161789 - DNA, 432 bp, Homo sapiens
  Payload ID: 11578
  Gene Symbol: OCIAD2
  Gene Name: OCIA domain containing 2
  ENST ID: ENST00000510159
  CDS Start-End: 133-318
cacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagcatgcttgtcacccagggactagtctaccaaggttatttggcagctaattctagatttggatcattgcccaaagttgcacttgctggtctcttgggatttggccttggaaaggtatcatacataggagtatgccaga

SEQ ID NO: 161790 - DNA, 697 bp, Homo sapiens
  Payload ID: 11578
  Gene Symbol: OCIAD2
  Gene Name: OCIA domain containing 2
  Uniprot ID: Q56VL3
  ENST ID: ENST00000620187
  CDS Start-End: 257-556
aggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagtgattctcttctaccttccttagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatgg

SEQ ID NO: 161791 - DNA, 5138 bp, Homo sapiens
  Payload ID: 11579
  Gene Symbol: OCRL
  Gene Name: oculocerebrorenal syndrome of Lowe
  Uniprot ID: Q01968
  ENST ID: ENST00000357121
  CDS Start-End: 166-2847
tctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 161792 - DNA, 5162 bp, Homo sapiens
  Payload ID: 11579
  Gene Symbol: OCRL
  Gene Name: oculocerebrorenal syndrome of Lowe
  Uniprot ID: Q01968
  ENST ID: ENST00000371113
  CDS Start-End: 166-2871
tctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggaagaagacagcttcctagaaaaggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 161793 - DNA, 3068 bp, Homo sapiens
  Payload ID: 11580
  Gene Symbol: OCA2
  Gene Name: oculocutaneous albinism II
  Uniprot ID: Q04671
  ENST ID: ENST00000353809
  CDS Start-End: 111-2555
cttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaa

SEQ ID NO: 161794 - DNA, 3186 bp, Homo sapiens
  Payload ID: 11580
  Gene Symbol: OCA2
  Gene Name: oculocutaneous albinism II
  Uniprot ID: Q04671
  ENST ID: ENST00000354638
  CDS Start-End: 157-2673
cctgggtgggggacccgctgcgggagcgccgagctccctctgagttcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaa

SEQ ID NO: 161795 - DNA, 750 bp, Homo sapiens
  Payload ID: 11580
  Gene Symbol: OCA2
  Gene Name: oculocutaneous albinism II
  ENST ID: ENST00000445578
  CDS Start-End: 95-750
tgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctgtcactcacaactggacggtgtatttaaatccgaggagaagcgagcactcagtgatgagcaggacctttgaggtactgaccag

SEQ ID NO: 161796 - DNA, 996 bp, Homo sapiens
  Payload ID: 11580
  Gene Symbol: OCA2
  Gene Name: oculocutaneous albinism II
  ENST ID: ENST00000431101
  CDS Start-End: 205-996
tccgctcaccatccagagcggaggtgcggaccttaaactcactcctggagaaagatctgcaagtgcgcaggtaaagtgcacgtgctccgcggtcgggaggaaggaggcgaggagccagactagcctgggaacaggcagggagggtttacacagccccggctgagtcgcggcttaggaagcaagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtgg

SEQ ID NO: 161797 - DNA, 396 bp, Homo sapiens
  Payload ID: 11580
  Gene Symbol: OCA2
  Gene Name: oculocutaneous albinism II
  ENST ID: ENST00000619392
  CDS Start-End: 1-396
atgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcagccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccgg

SEQ ID NO: 161798 - DNA, 2400 bp, Homo sapiens
  Payload ID: 11580
  Gene Symbol: OCA2
  Gene Name: oculocutaneous albinism II
  ENST ID: ENST00000632880
  CDS Start-End: 157-2400
cctgggtgggggacccgctgcgggagcgccgagctccctctgagttcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcagccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgtcttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatg

SEQ ID NO: 161799 - DNA, 750 bp, Homo sapiens; identical to SEQ ID NO: 161795
  Payload ID: 11580
  Gene Symbol: OCA2
  Gene Name: oculocutaneous albinism II
  ENST ID: ENST00000633787
  CDS Start-End: 95-750

SEQ ID NO: 161800 - DNA, 2282 bp, Homo sapiens
  Payload ID: 11580
  Gene Symbol: OCA2
  Gene Name: oculocutaneous albinism II
  ENST ID: ENST00000631387
  CDS Start-End: 111-2282
cttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgtcttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatg

SEQ ID NO: 161801 - DNA, 996 bp, Homo sapiens; identical to SEQ ID NO: 161796
  Payload ID: 11580
  Gene Symbol: OCA2
  Gene Name: oculocutaneous albinism II
  ENST ID: ENST00000632166
  CDS Start-End: 205-996

SEQ ID NO: 161802 - DNA, 884 bp, Homo sapiens
  Payload ID: 11581
  Gene Symbol: OCLM
  Gene Name: oculomedin
  Uniprot ID: Q9Y5M6
  ENST ID: ENST00000574641
  CDS Start-End: 475-609
gcccagcccacattagcttttgaagggaatatttttatgttcataggaaaaaaagcatagctcctctatataaccaacttcttttagtactactgatagctagtatgttaagtttgatggactaattataatcttttttttatattcctagtatgctggattctatgattggcagatttaacatttatccttctcgtaattcacaaccctaaagttccatttactaataatttataattttgctggaacatgaatttgaatcttacatgcaacaattggattgagagttttgggagggcagtatgtgggacctgttcacatagtccatcagtctagcagccccatctcagtgtggctttgtttttgcaatttgactttgagtttgtggtaactcctgtggtgtaaatcattgcttcaggttctgagcaacagtgtatattatagctgcattgcaggtttcaggatttgcagggtatggggatgtatccaccattattgttaaagatttaccttagcagacacattagtatactcttctatttaaaaatcctttataaaagtggtattatatggctatcctggtattctttcatattgttagtactttgaaatttttgctgatgttcaattagtaaaattaatggcccctaacagcagttgtactgtttgtatgttaaacttgatacatttagaagttaatgttaaagcctaatcctaaatttttaaaaggtgaaaaagtttttactggcaattgggtggccttgggacctgtgtgaagagcatagactgtagtttggtggaaagagcaaagactttgaagttctcggattctgtgtgtattctgctcctagcagagtgacctcaggcaaatgactttataggca

SEQ ID NO: 161803 - DNA, 1936 bp, Homo sapiens
  Payload ID: 11582
  Gene Symbol: OSR1
  Gene Name: odd-skipped related transciption factor 1
  Uniprot ID: Q8TAX0
  ENST ID: ENST00000272223
  CDS Start-End: 346-1146
aaataagtaggcggctcggtgctaagggatgagtgagtcggagctcggcctctccccggcacgttctcagctgctcctggttcagacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcattaaaaaaagaacgaaagctccgcggagccgcagcggcgcctctcccagaagtattactttttctattgttattttatacgttttcttttttatttttgtctttgaccatataagcttgtaactctgactgcggagagtgagtggagagaggagaggcaacgaagtccttagcactggcagctcccacctcctcctcccgcccctgcccccacccccggagcctgcaaaagtgtaatccctgtatctgcttcagcctcctgccctagggaccgcggggcagccccctcccagctcttgcagctcagctggcggccgtgggctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggagttttttttttttttaactattaaataaacggttattttacaggca

SEQ ID NO: 161804 - DNA, 1838 bp, Homo sapiens
  Payload ID: 11583
  Gene Symbol: OSR2
  Gene Name: odd-skipped related transciption factor 2
  Uniprot ID: Q8N2R0
  ENST ID: ENST00000297565
  CDS Start-End: 497-1435
agcctggggagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaactcc

SEQ ID NO: 161805 - DNA, 1736 bp, Homo sapiens
  Payload ID: 11583
  Gene Symbol: OSR2
  Gene Name: odd-skipped related transciption factor 2
  Uniprot ID: Q8N2R0
  ENST ID: ENST00000435298
  CDS Start-End: 481-1311
cgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaa

SEQ ID NO: 161806 - DNA, 2126 bp, Homo sapiens
  Payload ID: 11583
  Gene Symbol: OSR2
  Gene Name: odd-skipped related transciption factor 2
  Uniprot ID: Q8N2R0
  ENST ID: ENST00000457907
  CDS Start-End: 422-1723
cggggccgctactaaagcccaagactcccggcctggggcagcctggggagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaactcc

SEQ ID NO: 161807 - DNA, 1048 bp, Homo sapiens
  Payload ID: 11583
  Gene Symbol: OSR2
  Gene Name: odd-skipped related transciption factor 2
  ENST ID: ENST00000518199
  CDS Start-End: 410-1048
caggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagat

SEQ ID NO: 161808 - DNA, 1519 bp, Homo sapiens
  Payload ID: 11583
  Gene Symbol: OSR2
  Gene Name: odd-skipped related transciption factor 2
  ENST ID: ENST00000523368
  CDS Start-End: 497-1363
agcctggggagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggtaagtttgttttcttgtttaaaaacagtggctggttcgtgttatcattactgctttgcaaaaggtgttcaatggcagactctttctcttaaaaggctctatttagattagttctctaggtggggaaaagcaacacttgatttctttaatacataaaattaatcttgtttaacataaagcatttttatatttttctcaaaaaacggccactttgattatcataaatcctaattttagaatttttttcatccaatctgtcctgcattt

SEQ ID NO: 161809 - DNA, 853 bp, Homo sapiens
  Payload ID: 11583
  Gene Symbol: OSR2
  Gene Name: odd-skipped related transciption factor 2
  ENST ID: ENST00000520951
  CDS Start-End: 43-853
ggggcgaggtgagcccctcccagggccctctggcccaggaggatgaagcgcgccggcttcgctcttgcacgccggcttgccatccggggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatc

SEQ ID NO: 161810 - DNA, 1528 bp, Homo sapiens
  Payload ID: 11583
  Gene Symbol: OSR2
  Gene Name: odd-skipped related transciption factor 2
  Uniprot ID: Q8N2R0
  ENST ID: ENST00000522510
  CDS Start-End: 529-1467
tcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtct

SEQ ID NO: 161811 - DNA, 1319 bp, Homo sapiens
  Payload ID: 11584
  Gene Symbol: ODAM
  Gene Name: odontogenic, ameloblast asssociated
  Uniprot ID: A1E959
  ENST ID: ENST00000396094
  CDS Start-End: 49-888
ttataaagctaaagatcacaacttattttctagatatatcatacgaaaatgaaaattataattcttcttggattcctgggagccacattgtcagccccacttatcccacagcgtctcatgtctgccagcaatagcaatgagttacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatcaattggataattgcattagtaaatgatgcctctgcaaaatggtagtacccatgaagatatgtatattgtcattggatgtatgatgagtgttgtgattggaactgatgaagtaaaataagtatctagatttga

SEQ ID NO: 161812 - DNA, 605 bp, Homo sapiens
  Payload ID: 11584
  Gene Symbol: ODAM
  Gene Name: odontogenic, ameloblast asssociated
  ENST ID: ENST00000510847
  CDS Start-End: 1-93
caaacaccgcctcagacacaaccaggccccagtcacgtgatgccctatgtattctccttcaaaatgcctcaagagcaaggacagaacatctaataccacattctgcagaatgatgattctcaaaaatataggatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggat

SEQ ID NO: 161813 - DNA, 780 bp, Homo sapiens
  Payload ID: 11584
  Gene Symbol: ODAM
  Gene Name: odontogenic, ameloblast asssociated
  ENST ID: ENST00000510709
  CDS Start-End: 20-780
ctagatatatcatacgaaaatgaaaattataattcttcttggattcctgggagccacattgtcagccccattacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccaga

SEQ ID NO: 161814 - DNA, 680 bp, Homo sapiens
  Payload ID: 11584
  Gene Symbol: ODAM
  Gene Name: odontogenic, ameloblast asssociated
  ENST ID: ENST00000514097
  CDS Start-End: 1-651
ggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcaggctatatcaggaggacagcagcaactagcttttgatccccaactaggcacagctcctgaaattgctgtgatgtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttg

SEQ ID NO: 161815 - DNA, 607 bp, Homo sapiens
  Payload ID: 11585
  Gene Symbol: OBP2A
  Gene Name: odorant binding protein 2A
  ENST ID: ENST00000342114
  CDS Start-End: 43-486
cgcccagtgacctgccgaggtcggcagcacagagctctggagatgaagaccctgttcctgggtgtcacgctcggcctggccgctgccctgtccttcaccctggaggaggaggatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggcatctgctccctgcagggccgtgccgctgtccccaccttggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaag

SEQ ID NO: 161816 - DNA, 741 bp, Homo sapiens
  Payload ID: 11585
  Gene Symbol: OBP2A
  Gene Name: odorant binding protein 2A
  ENST ID: ENST00000340780
  CDS Start-End: 43-729
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggcatctgctccctgcagggccgtgccgctgtccccaccttggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaag

SEQ ID NO: 161817 - DNA, 689 bp, Homo sapiens
  Payload ID: 11585
  Gene Symbol: OBP2A
  Gene Name: odorant binding protein 2A
  Uniprot ID: Q9NY56
  ENST ID: ENST00000371776
  CDS Start-End: 43-555
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtgggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaagagcttctccccca

SEQ ID NO: 161818 - DNA, 725 bp, Homo sapiens
  Payload ID: 11585
  Gene Symbol: OBP2A
  Gene Name: odorant binding protein 2A
  ENST ID: ENST00000471886
  CDS Start-End: 43-483
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggggccgtgccgctgtccccaccttggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaag

SEQ ID NO: 161819 - DNA, 914 bp, Homo sapiens
  Payload ID: 11585
  Gene Symbol: OBP2A
  Gene Name: odorant binding protein 2A
  Uniprot ID: Q9NY56
  ENST ID: ENST00000539850
  CDS Start-End: 27-539
gaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtgggtaggaatcctaataccaacctggaggccctggaagaatttaagaaattggtgcagcacaagggactctcggaggaggacattttcatgcccctgcagacgggaagctgcgttctcgaacactaggcgaggcctccctccggctccctcaggtgtcagctcggcccatcgccccctgcacctgtccccactcggtctactcccccccacccactcaccaaggatgctcagaggcctgcccagtcattggaggagctgaggctgctctggagccccgaggctgcccagcagtggccgatgtggaagctgcagagcctggggagggagctctgggcctggcctctgccctaccctgcagcctccctgacctctgctcctcttcccagcacagcagcccccgggtctgcacctccagagcccaccctaccaccagacacagagcccggaccacctggacctaccctccagccatgacccttccctgctcccacccacctgact

SEQ ID NO: 161820 - DNA, 542 bp, Homo sapiens
  Payload ID: 11585
  Gene Symbol: OBP2A
  Gene Name: odorant binding protein 2A
  ENST ID: ENST00000537747
  CDS Start-End: 43-300
cgcccagtgacctgccgaggtcggcagcacagagctctggagatgaagaccctgttcctgggtgtcacgctcggcctggccgctgccctgtccttcaccctggaggaggaggatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtgggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaag

SEQ ID NO: 161821 - DNA, 705 bp, Homo sapiens
  Payload ID: 11585
  Gene Symbol: OBP2A
  Gene Name: odorant binding protein 2A
  ENST ID: ENST00000619164
  CDS Start-End: 43-705
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggcatctgctccctgcagggccgtgccgctgtccccaccttggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactagggtgacccccgggtctgcacctccagagcccaccctaccaccagacacagagcccggaccacctggacctaccctccagccatga

SEQ ID NO: 161822 - DNA, 702 bp, Homo sapiens
  Payload ID: 11586
  Gene Symbol: OBP2B
  Gene Name: odorant binding protein 2B
  ENST ID: ENST00000372032
  CDS Start-End: 29-691
ccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggataggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtggcatctgctccctgcagggccgtgccgctgtccccacgtcggctcacctggccacctcacctgcaggtaggaattctgataccaaccgggaggccctggaagaatttaagaaattggtgcagcgcaagggactctcggaggaggacattttcacgcccctgcagacgggaagctgcgttcccgaacactaggcaggcccccgggtctgcacctccagagcccaccctaccaccagacacagagcctggaccacctggacctaccctccagccatgacccttccctgc

SEQ ID NO: 161823 - DNA, 691 bp, Homo sapiens
  Payload ID: 11586
  Gene Symbol: OBP2B
  Gene Name: odorant binding protein 2B
  Uniprot ID: Q9NPH6
  ENST ID: ENST00000372034
  CDS Start-End: 43-555
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggataggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcctggaccacctggacctaccctccagccatgacccttccctgctcccacccacctgactccaaataaagtccttctcccccagc

SEQ ID NO: 161824 - DNA, 797 bp, Homo sapiens
  Payload ID: 11586
  Gene Symbol: OBP2B
  Gene Name: odorant binding protein 2B
  Uniprot ID: Q9NPH6
  ENST ID: ENST00000473737
  CDS Start-End: 43-540
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggataggtgcatccagaagaaaatcctgatgcggaagacggaggagcctggcaaatacagcgcctgcttgtccgcagtcgagatggaccagatcacgcctgccctctgggaggccctagccattgacacattgaggaagctgaggattgggacaaggaggccaaggattagatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcctggaccacctggacctaccctccagccatgacccttccctgctcccacccacctgactccaaataaagtccttctcccccagc

SEQ ID NO: 161825 - DNA, 961 bp, Homo sapiens
  Payload ID: 11586
  Gene Symbol: OBP2B
  Gene Name: odorant binding protein 2B
  Uniprot ID: Q9NPH6
  ENST ID: ENST00000618116
  CDS Start-End: 52-564
ttgttcagacgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggataggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcgaggcctccctccggctccctcaggtgtcagctcagcccatcgccccctgcacctgtccccacgcggtccactccccaccatccacccaccaaggatgctcagaggcctgcccagtcattggaggagctgaggtcgctctggagccccgaggttgcccagcagtggccgatgtgggggctgcagagcctggggagggagctctggccctggcctctgccctaccctgcagcctccctgacctctgctcctcttcccagcacagcagcccccgggtctgcacctccagagcccaccctaccaccagacacagagcctggaccacctggacctaccctccagccatgacccttccctgctcccacccacctgactccaaataaagtccttctccccc

SEQ ID NO: 161826 - DNA, 961 bp, Homo sapiens; identical to SEQ ID NO: 161825
  Payload ID: 11587
  Gene Symbol:
  Gene Name: Odorant-binding protein 2b  [Source:UniProtKB/Swiss-Prot
  Acc:Q9NPH6]
  Uniprot ID: Q9NPH6
  ENST ID: ENST00000628865
  CDS Start-End: 52-564

SEQ ID NO: 161827 - DNA, 797 bp, Homo sapiens; identical to SEQ ID NO: 161824
  Payload ID: 11587
  Gene Symbol:
  Gene Name: Odorant-binding protein 2b  [Source:UniProtKB/Swiss-Prot
  Acc:Q9NPH6]
  Uniprot ID: Q9NPH6
  ENST ID: ENST00000630166
  CDS Start-End: 43-540

SEQ ID NO: 161828 - DNA, 702 bp, Homo sapiens; identical to SEQ ID NO: 161822
  Payload ID: 11587
  Gene Symbol:
  Gene Name: Odorant-binding protein 2b  [Source:UniProtKB/Swiss-Prot
  Acc:Q9NPH6]
  ENST ID: ENST00000629408
  CDS Start-End: 29-691

SEQ ID NO: 161829 - DNA, 691 bp, Homo sapiens; identical to SEQ ID NO: 161823
  Payload ID: 11587
  Gene Symbol:
  Gene Name: Odorant-binding protein 2b  [Source:UniProtKB/Swiss-Prot
  Acc:Q9NPH6]
  Uniprot ID: Q9NPH6
  ENST ID: ENST00000627758
  CDS Start-End: 43-555

SEQ ID NO: 161830 - DNA, 1767 bp, Homo sapiens
  Payload ID: 11588
  Gene Symbol: OLAH
  Gene Name: oleoyl-ACP hydrolase
  Uniprot ID: Q9NV23
  ENST ID: ENST00000378217
  CDS Start-End: 188-1144
agagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagagacagcatctcaccatgttgccaaggctggtctcaaactccggcgctcaagtgatcctcctgcttcagcctacccatgtgctggcgtgagccaccgtaggcgtgagccaccgtgcctggccaaaattcttggtctattctggattctaattttttttatgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagccgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 161831 - DNA, 810 bp, Homo sapiens
  Payload ID: 11588
  Gene Symbol: OLAH
  Gene Name: oleoyl-ACP hydrolase
  ENST ID: ENST00000378225
  CDS Start-End: 224-637
caatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggcaggccaccccttgtgccaccaggctcttcctccatcccaggggctccgataccctgcctttgaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacaggtatttgatatctgttttaaaagacttcaggggagtttcttctatctgaagtttgaggttaatgttattctttgtgttttgtaagatgcatacctttgtattggttagacagcatgttaggtaattatggccatcacaacttttacaattcaccagtttgtatggtaagtatacctattttttttccttttaggcaaataaagtcaacacttgtaaaaccaa

SEQ ID NO: 161832 - DNA, 1675 bp, Homo sapiens
  Payload ID: 11588
  Gene Symbol: OLAH
  Gene Name: oleoyl-ACP hydrolase
  Uniprot ID: Q9NV23
  ENST ID: ENST00000378228
  CDS Start-End: 255-1052
acctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagccgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 161833 - DNA, 717 bp, Homo sapiens
  Payload ID: 11588
  Gene Symbol: OLAH
  Gene Name: oleoyl-ACP hydrolase
  ENST ID: ENST00000428897
  CDS Start-End: 288-717
tcccatgctggatgcttcccgcccttgaacatcagactccaatttcttcagttctgggactctgactggcttccttgctcctcagcctgcagatggcctattgtgagacctcacgttgtcatatggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaag

SEQ ID NO: 161834 - DNA, 551 bp, Homo sapiens
  Payload ID: 11588
  Gene Symbol: OLAH
  Gene Name: oleoyl-ACP hydrolase
  ENST ID: ENST00000413672
  CDS Start-End: 262-551
gaacatcagactccaatttcttcagttctgggactctgactggcttccttgctcctcagcctgcagatggcctattgtgagacctcacgttgtcatatggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagagacagcatctcaccatgttgccaaggctggtctcaaactccggcgctcaagtgatcctcctgcttcagcctacccatgtgctggcgtgagccaccgtaggcgtgagccaccgtgcctggccaaaat

SEQ ID NO: 161835 - DNA, 768 bp, Homo sapiens
  Payload ID: 11588
  Gene Symbol: OLAH
  Gene Name: oleoyl-ACP hydrolase
  ENST ID: ENST00000429028
  CDS Start-End: 226-768
atgtgacttgcttctccttgccttccaccatgattgtgaggcctccccagctatgtggcactggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagg

SEQ ID NO: 161836 - DNA, 2591 bp, Homo sapiens
  Payload ID: 11589
  Gene Symbol: OLFM1
  Gene Name: olfactomedin 1
  Uniprot ID: Q99784
  ENST ID: ENST00000252854
  CDS Start-End: 188-1591
gggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggaga

SEQ ID NO: 161837 - DNA, 1014 bp, Homo sapiens
  Payload ID: 11589
  Gene Symbol: OLFM1
  Gene Name: olfactomedin 1
  Uniprot ID: Q99784
  ENST ID: ENST00000277415
  CDS Start-End: 286-693
gcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttcccaaatat

SEQ ID NO: 161838 - DNA, 542 bp, Homo sapiens
  Payload ID: 11589
  Gene Symbol: OLFM1
  Gene Name: olfactomedin 1
  ENST ID: ENST00000339720
  CDS Start-End: 53-542
gtagtgagtgatctggaggattctttccttcccaaatggctgggaaagcttaatggaaggccccggaggaagtggctttcatctccgattagaagccttctgtaaatgcaaaagccctattaacgtgtttgacccagtcaggcctgcgcttcaggtgggactgacacgcgtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatg

SEQ ID NO: 161839 - DNA, 2444 bp, Homo sapiens
  Payload ID: 11589
  Gene Symbol: OLFM1
  Gene Name: olfactomedin 1
  Uniprot ID: Q99784
  ENST ID: ENST00000371793
  CDS Start-End: 252-1709
ggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaa

SEQ ID NO: 161840 - DNA, 2492 bp, Homo sapiens
  Payload ID: 11589
  Gene Symbol: OLFM1
  Gene Name: olfactomedin 1
  Uniprot ID: Q99784
  ENST ID: ENST00000371796
  CDS Start-End: 115-1491
gaatcaccgcggaaaagggctccagtaggcaggacggcgccgtctctctgccggcaacctttgccccaaagcggaccctctgcggggatcggagagggatgccccggcgtgaggatgggagaagccccgggacgggagggccgcgggccgtgcccccagctggagtccccgcgccgccgccgggtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagat

SEQ ID NO: 161841 - DNA, 961 bp, Homo sapiens
  Payload ID: 11589
  Gene Symbol: OLFM1
  Gene Name: olfactomedin 1
  ENST ID: ENST00000371799
  CDS Start-End: 286-789
gcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaaaataaaagagaaaacaaagcagagaagatgggagggccagagagcgagaggaagaccacaggagagaagacactgaacgagcttcccttgttttgcctggaagcccacgctggctccctggctctgcccaggatgtgcagtccaaatcccaatccagcagtggggttatgtcgtcccgcttaccctcagagcccttctcctggtgctgcccagacgatcagccagtccctcctggagaggttctgcatggcctctaggagaggttttcttggccccaggaaggcctggtggagggtggtggttgtgcactgttgctggacagatgcattcattcatgtgcacacacacacacacacatgcacacacaggggagcagatacctgcagagaagagccaaccaggtcctgattagtggcaagctgccccacaaagggctatgcctgtgtcttattgagacaccttggcaaagagatggctgattctgggtggtcctggacatggccgcacccaagggccctccaagccttaatggcaccctgaagcctccatgcccaggccaaaagatgcttttcctccctaa

SEQ ID NO: 161842 - DNA, 568 bp, Homo sapiens
  Payload ID: 11589
  Gene Symbol: OLFM1
  Gene Name: olfactomedin 1
  ENST ID: ENST00000371801
  CDS Start-End: 42-431
cgtccacgcagccgccggccggccagcacccagggccctgcatgccaggtcgttggaggtggcagcgagacatgcacccggcccggaagctcctcagcctcctcttcctcatcctgatgggcactgaactcactcaagactccgctgcccccgactccctgctgagaagttcaaagggcagcacgagggggtctttggctgctattgtcatctggagggggaagagtgagagccggatagccaagaccccaggcattttcagaggtggcgggaccttagtcctacccccaacacacacccctgagtggctcatcctccctttgggcataacgctgcccttgggggctccagaaacaggcggtggggattgtgccgctgagacctggaagggcagccagcgtgccggccagctgtgtgcattgctggcttaatatgcagggcttggggggctgtggccacatgcccggcaggaggtgagtgaggagccctgtggcgtgctggtgtggggatcgtgggcatttcaaacgggcttgtcgtaccctgaacaatgtatcaatagagaaaggtc

SEQ ID NO: 161843 - DNA, 1057 bp, Homo sapiens
  Payload ID: 11589
  Gene Symbol: OLFM1
  Gene Name: olfactomedin 1
  Uniprot ID: Q99784
  ENST ID: ENST00000392991
  CDS Start-End: 317-778
ggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaag

SEQ ID NO: 161844 - DNA, 727 bp, Homo sapiens
  Payload ID: 11589
  Gene Symbol: OLFM1
  Gene Name: olfactomedin 1
  ENST ID: ENST00000545657
  CDS Start-End: 1-298
gagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactaggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctggaacacgagctaccccaagcgcagcgccggggaggccttcatcatctgcggcacgctgtacgtcaccaacggctactc

SEQ ID NO: 161845 - DNA, 791 bp, Homo sapiens
  Payload ID: 11589
  Gene Symbol: OLFM1
  Gene Name: olfactomedin 1
  ENST ID: ENST00000539877
  CDS Start-End: 167-791
gctgcactaaaactgtttttcttttaagctccctggaatcctgttgaatattaaagttccatcttgaggctagactcaattcagatctgcctgtaaagatgtaaaacagcgattcttcatttgctgggtgattgattcctgactctatgctcagaatgtacataacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctact

SEQ ID NO: 161846 - DNA, 546 bp, Homo sapiens
  Payload ID: 11589
  Gene Symbol: OLFM1
  Gene Name: olfactomedin 1
  ENST ID: ENST00000539529
  CDS Start-End: 159-546
gagccggacggcgcttcccggtggcggcggaggagcccggagggacgcagccgggcaaggtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtcca

SEQ ID NO: 161847 - DNA, 971 bp, Homo sapiens
  Payload ID: 11589
  Gene Symbol: OLFM1
  Gene Name: olfactomedin 1
  ENST ID: ENST00000615948
  CDS Start-End: 465-971
atcctgtcccagcctgcttccccgccggccgccgccctcctccccgggagagagcgaggcgcgcgggtccctctgcgccacccccgcccccgccccttccgagcaaacttttggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaaaataaaagagaaaacaaagcagagaagatgggagggccagagagcgagaggaagaccacaggagagaagacactgaacgagcttcccttgttttgcctggaagcccacgctggctccctggctctgcccaggatgtgcagtccaaatcccaatccagcagtggggttatgtcgtcccgcttaccctcagagcccttctcctggtgctgcccagacgatcagccagtccctcctggagaggttctgcatggcctctaggagagttttcttggccccaggaaggcctggtggagggtggtggttgtgcactgttgctggacagatgcattcattcatgtgcacacacacacacacacatgcacacacaggggagcagatacctgcagagaagagccaaccaggtcctgattag

SEQ ID NO: 161848 - DNA, 2019 bp, Homo sapiens
  Payload ID: 11590
  Gene Symbol: OLFM2
  Gene Name: olfactomedin 2
  Uniprot ID: O95897
  ENST ID: ENST00000264833
  CDS Start-End: 187-1551
cgcaacaaagactcggagcgagcgagggggcgggggtggggcggaatcccggccgccggcgaggcgggggaggcggcggcgcagggtcgccccggccgggcgggcggggtcgcgcctggtggcggtccccgcgccgaggcgccgctagggcgggcgggggtcgggacgccgggctaggggcgcgtcatgtggccgctcacggtcccgccgccgctgctgctgctgctgtgctcaggcctggccggacagactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctctgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 161849 - DNA, 1665 bp, Homo sapiens
  Payload ID: 11590
  Gene Symbol: OLFM2
  Gene Name: olfactomedin 2
  ENST ID: ENST00000590841
  CDS Start-End: 94-1224
aagttccttctgtctgctgtgtagagaattgactacaggggatgaaggtggaactgggagactagggaggaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctctgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgcc

SEQ ID NO: 161850 - DNA, 1226 bp, Homo sapiens
  Payload ID: 11590
  Gene Symbol: OLFM2
  Gene Name: olfactomedin 2
  ENST ID: ENST00000593091
  CDS Start-End: 220-1226
cggcgctttataagaggagcccgccaggcgcgccgagccgcagcccgcgtccccgagccccccctcaccccgtcccggaccccctgccccgcagctcgcgctcgtgccccctcccccacgcccccccggggcgcctgggtgtcgagggaccgagcgccccgcggcgggccagagaagggacgcgcggcgggcggccgcggggcatgaggcggaggcgcgatgtcggtgccgctgctcaagatcggggccgtgctgagcaccatggccatggtcaccaactggatgtcgcagacgctgccctcgctcgtggggctcaacggcaccgtgtcccgtgcgggcgcctctgagaaaatcactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacac

SEQ ID NO: 161851 - DNA, 713 bp, Homo sapiens
  Payload ID: 11590
  Gene Symbol: OLFM2
  Gene Name: olfactomedin 2
  ENST ID: ENST00000592448
  CDS Start-End: 72-308
agagaattgactacaggggatgaaggtggaactgggagactagggaggaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctggg

SEQ ID NO: 161852 - DNA, 2189 bp, Homo sapiens
  Payload ID: 11591
  Gene Symbol: OLFM3
  Gene Name: olfactomedin 3
  Uniprot ID: Q96PB7
  ENST ID: ENST00000338858
  CDS Start-End: 1-1437
atgagtcctccactgctgaagcttggcgctgtgcttagtaccatggcaatgatctcaaactggatgtcccaaactctcccatccttggtgggactgaacaccacgaggctgtcgactccggataccttaactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaa

SEQ ID NO: 161853 - DNA, 3255 bp, Homo sapiens
  Payload ID: 11591
  Gene Symbol: OLFM3
  Gene Name: olfactomedin 3
  Uniprot ID: Q96PB7
  ENST ID: ENST00000370103
  CDS Start-End: 215-1591
tcctagctctgagaatgcctgcggaatgatcgccccccagggcggctgccgccgctgccgctgctgctgttattgctactgctgctgccgccgcctctgcttccactcggctctgactggcaggcagaaagtgcaactgacgagggaaaggtctctgcagtgagtggagagcctacataaaagagagtaaagaggggcaaaaacccagatcagaatgcaggcgacgtccaaccttctcaacctcctgctgctgtctttgtttgccggattagatccttccaagactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatgtggaaaaataatgtaaccaaaagggaagagctttaataatacttatgttaataactctatgaaacatataagctaactatatatcaaacatttcattgagtttggatgtattttccacatattaaaaaaatagttccctaaggcagctttatggaaactaatataggttggttttacaatttaaaaagtatattctataataaataataaaacaaattgttttaaatgtttagtttcacacatacatagtaccatgattttctttgaaagataaggatgtaatgatttagataaagcatcatgtaaagaaatcctaacatttaagtgtaattcatttcaaatgtcacaagtaaagcatcatcctcaaatatctcactgtcaaaattgtagaattaaataacccaatcttgaaa

SEQ ID NO: 161854 - DNA, 2801 bp, Homo sapiens
  Payload ID: 11591
  Gene Symbol: OLFM3
  Gene Name: olfactomedin 3
  Uniprot ID: Q96PB7
  ENST ID: ENST00000536598
  CDS Start-End: 161-583
tcagactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaattgatttaaaaaagagaaaagaagaagaaaaaaggcaacagaaaggagaagcataagcaatagtattttgggaagctataacacgcgacttgcctccctgttcacctttgtattctcagcacctagaatagttctggtacaaaataagttcacagtaaatggttgtcaaatgaataaattaattattatatctttaaatagtaactattgtttttaccctctaacatatttcagagaaatgcttagtgctacaagaaagtaaagtttgctttctaaggtatgattgactggagtaagaatcaattttcctcacaaaaccaggtacaaaataaaagagtcaactagccaaaagaccactttaccatggtcacccaatgtttagtttaagagccagaagcttttaacctccggtacaaattctgtcctaagttttggccgaaacaacctaagactcagcagtatccctttgccatagagatgcaaggctggattagattcaagcaccatcgaagccaaagacaccccaagccagtgatgtgctgtgggttgtttggaaatgtcgattagataaggctcatggtatgattcagagctccaaggacagttcttgttcaggtttcaactaatcaacatcggattatgcacacctcaacatctgaaatatgcagacatttgagacaaataccagaattgtgtcttcttgctttgtacaaatcatgcttcagtctggcaataagcatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaa

SEQ ID NO: 161855 - DNA, 2897 bp, Homo sapiens
  Payload ID: 11592
  Gene Symbol: OLFM4
  Gene Name: olfactomedin 4
  Uniprot ID: Q6UX06
  ENST ID: ENST00000219022
  CDS Start-End: 79-1611
atggggaaatcaccactgggcactataagaagcccctgggctctctgcagagccagcggctccagctaagaggacaagatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaa

SEQ ID NO: 161856 - DNA, 2792 bp, Homo sapiens
  Payload ID: 11593
  Gene Symbol: OLFML1
  Gene Name: olfactomedin-like 1
  Uniprot ID: Q6UWY5
  ENST ID: ENST00000329293
  CDS Start-End: 395-1603
gggggaagggaacggggggaagccatcttcaccccccaccccaatgcacacacaattaagccaggaagcagcttgcaaccactagcctggggagggtccgcatgtgtcaagggtgagggcaacagatgctggacccagggagctctctgccacaggtcagtctacaaggcctcagggaccaacttgccaacagctggacttgatcactagctggcaaactgagctcacgtatcgggtggaataacaagcggactttgctctctgctgtgcaaaacgctgtttttagaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcatttaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaataacctcatcaggttatatttgcccacataccctaagcacaaaa

SEQ ID NO: 161857 - DNA, 575 bp, Homo sapiens
  Payload ID: 11593
  Gene Symbol: OLFML1
  Gene Name: olfactomedin-like 1
  ENST ID: ENST00000534244
  CDS Start-End: 371-575
atcttcaccccccaccccaatgcacacacaattaagccaggaagcagcttgcaaccactagcctggggagggtccgcatgtgtcaagggtgagggcaacagatgctggacccagggagctctctgccacaggtcagtctacaaggcctcagggaccaacttgccaacagctggacttgatcactagctggcaaactgagctcacgtatcgggtggaataacaagcggactttgctctctgctgtgcaaaacgctgtttttagaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagggctggaaaaatgtacccaagcaacgagggcatacattcaagaattccaagagttctcaaaaaatatatctgtcat

SEQ ID NO: 161858 - DNA, 1620 bp, Homo sapiens
  Payload ID: 11593
  Gene Symbol: OLFML1
  Gene Name: olfactomedin-like 1
  Uniprot ID: Q6UWY5
  ENST ID: ENST00000530135
  CDS Start-End: 251-1459
aaaaagttgggggtggtttgtgttggggaaggcctgcgattggactgcagaatccactagggaggaggaaagcaaaagtaaaaaggaaatagctgggggaagggaacggggggaagccatcttcaccccccaccccaatgcacacacaattaagccaggaagcagcttgcaaccactagcctggggagggtccgcatgtgtcaagggtgagggcaacagatgctggacccagggagctctctgccacaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgcctta

SEQ ID NO: 161859 - DNA, 1438 bp, Homo sapiens
  Payload ID: 11593
  Gene Symbol: OLFML1
  Gene Name: olfactomedin-like 1
  ENST ID: ENST00000528758
  CDS Start-End: 271-441
gatgctggacccagggagctctctgccacaggtcagtctacaaggcctcagggaccaacttgccaacagctggacttgatcactagctggcaaactgagctcacgtatcgggtggaataacaagcggactttgctctctgctgtgcaaaacgctgtttttagaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattact

SEQ ID NO: 161860 - DNA, 5964 bp, Homo sapiens
  Payload ID: 11594
  Gene Symbol: OLFML2A
  Gene Name: olfactomedin-like 2A
  Uniprot ID: Q68BL7
  ENST ID: ENST00000288815
  CDS Start-End: 175-1491
catatcctagaggttgggtgaccaaccctgtcccagtttgcctgggacttgagggtttttccaggatgcagcactttcagtgctaaaactaggaatgttccaggcactctgggatgagttggtcaccttgcctaggtgcctaagaacctctcccctgcccacgtactaagaccaatgagtaagagagacaaggctgggaaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctcccctccctgccctcccccatctccccggtctcccttgttctctcaacccagtctcccttcccagggccactcagaaccagaggtctttagggccagtgtactggtgtggggtggaggccctggctctgcctgccatcctagggccctgttctggctgagctgttggtggccctgggctttgggccccttagccaatgtccttgtctcttgtctttggccagccccctcagcccagcccaccccacccgctgtccggccacattccaaacctctaccgtcacctagctgctgagcagaaaccgcaccccgagagaaaatcccatcctctgttccaaggcccctgtctgctctatgctcatttttattttctcttattcttcatcagtgccgtcatttgtttctgcagcagcagctgagaaggcagccggcagctctgccagggtggggagctgagctgaggctccctctccacccagaagcactggcgttgttcacatagtcaggccttgggtcccctccctggttcatcccagagcctttgggcctggagtccgccttgtcctttttctctgggctttcaaacccacaacctttacacactcagggatacctccgggtctgccatgaataagaccctaggcccaagtctggtgtggtgccaggatggcacagtttccctcttccttgccagccctgacctggtcactgggcaggctggcccagcagcctgggggctgcagaagacatggtgtgagtagttgggtccaggggaggcatcaggccttcttctggttgcaggagagaaccagagggtgggaacggggagggaagaactgagggtctgcagactggacttttcctggctcgacccaggacttgggttgaggatgcacgggggccaccttgcccggggccactggtggctccccagagcctcagacccacacagcccagaggacgaggccttcaagcctgcccctcttctgcttttttagacagtatttttagagctggaaagaaattttctagcccaactccctgtttcatgaaagagaaaagaggctcagaaaagtttagagagcagctcagtgtcacactgggagctgggcacagccgatctccttccagaagggttctgtctgtatcctttattctccgcacatggaggctgccctacctgggaaggcaccccagcacctgtgaaggacatttactgctcatcctcacctgccccctggcccttgctgccttcattctgtcccaatgccagctccctggatgtctgtatgtttgaataccagttgccatgttaggaaggtcagctgcacagccaagagtgtaagagtgtaaagaaatgcctttttttttttttttgagttggagttttgctcttgtcgcccaggctggagtgcagtggcgcgatctcggctcactgcaacctctgccccctgggttcaagcgattctcctgcctcagcctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacacttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaagtc

SEQ ID NO: 161861 - DNA, 1067 bp, Homo sapiens
  Payload ID: 11594
  Gene Symbol: OLFML2A
  Gene Name: olfactomedin-like 2A
  ENST ID: ENST00000331715
  CDS Start-End: 114-1067
gcaggcgcggggcgcggggcaggcagagcgggcgaaggcgcggagctcgcagtgcagcccgcgcttcccagcgtccgtgcccggccgcctgtgcctaccgtgcccgtggcgccatggccgctgccgccctcccgccccggccgctgctccttctgccgctagtgctgctgctgagcggccgccccacgcgcgccgacagtaaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagagcatcaaggccaacctgagccgggagaatgaggtggtgaaggacagcgtgcgccacctcagtgagcagttgaggcactatgagaatcactctgccatcatgctgggcatcaagaaggagctgtcccgcctgggcctccagctgctgcagaaggatgccgccgccgcccctgccacccctgccacgggcactggtagcaaggcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacc

SEQ ID NO: 161862 - DNA, 6425 bp, Homo sapiens
  Payload ID: 11594
  Gene Symbol: OLFML2A
  Gene Name: olfactomedin-like 2A
  Uniprot ID: Q68BL7
  ENST ID: ENST00000373580
  CDS Start-End: 1-1959
atggccgctgccgccctcccgccccggccgctgctccttctgccgctagtgctgctgctgagcggccgccccacgcgcgccgacagtaaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagctgcagtccatggtggatctcctggagggcaccctgtacagcatggacttgatgaaggtgcacgcctacgtccacaaggtggcctcccagatgaacacactggaagagagcatcaaggccaacctgagccgggagaatgaggtggtgaaggacagcgtgcgccacctcagtgagcagttgaggcactatgagaatcactctgccatcatgctgggcatcaagaaggagctgtcccgcctgggcctccagctgctgcagaaggatgccgccgccgcccctgccacccctgccacgggcactggtagcaaggcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctcccctccctgccctcccccatctccccggtctcccttgttctctcaacccagtctcccttcccagggccactcagaaccagaggtctttagggccagtgtactggtgtggggtggaggccctggctctgcctgccatcctagggccctgttctggctgagctgttggtggccctgggctttgggccccttagccaatgtccttgtctcttgtctttggccagccccctcagcccagcccaccccacccgctgtccggccacattccaaacctctaccgtcacctagctgctgagcagaaaccgcaccccgagagaaaatcccatcctctgttccaaggcccctgtctgctctatgctcatttttattttctcttattcttcatcagtgccgtcatttgtttctgcagcagcagctgagaaggcagccggcagctctgccagggtggggagctgagctgaggctccctctccacccagaagcactggcgttgttcacatagtcaggccttgggtcccctccctggttcatcccagagcctttgggcctggagtccgccttgtcctttttctctgggctttcaaacccacaacctttacacactcagggatacctccgggtctgccatgaataagaccctaggcccaagtctggtgtggtgccaggatggcacagtttccctcttccttgccagccctgacctggtcactgggcaggctggcccagcagcctgggggctgcagaagacatggtgtgagtagttgggtccaggggaggcatcaggccttcttctggttgcaggagagaaccagagggtgggaacggggagggaagaactgagggtctgcagactggacttttcctggctcgacccaggacttgggttgaggatgcacgggggccaccttgcccggggccactggtggctccccagagcctcagacccacacagcccagaggacgaggccttcaagcctgcccctcttctgcttttttagacagtatttttagagctggaaagaaattttctagcccaactccctgtttcatgaaagagaaaagaggctcagaaaagtttagagagcagctcagtgtcacactgggagctgggcacagccgatctccttccagaagggttctgtctgtatcctttattctccgcacatggaggctgccctacctgggaaggcaccccagcacctgtgaaggacatttactgctcatcctcacctgccccctggcccttgctgccttcattctgtcccaatgccagctccctggatgtctgtatgtttgaataccagttgccatgttaggaaggtcagctgcacagccaagagtgtaagagtgtaaagaaatgcctttttttttttttttgagttggagttttgctcttgtcgcccaggctggagtgcagtggcgcgatctcggctcactgcaacctctgccccctgggttcaagcgattctcctgcctcagcctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacacttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgattt

SEQ ID NO: 161863 - DNA, 3160 bp, Homo sapiens
  Payload ID: 11595
  Gene Symbol: OLFML2B
  Gene Name: olfactomedin-like 2B
  Uniprot ID: Q68BL8
  ENST ID: ENST00000294794
  CDS Start-End: 425-2677
gcccgcgccgccaccgcctcttccctccccgtgtccggtccccgtgcgtcccgaggctccccgccgcccgtcccggcgcgcaccgcgggcgtctgtccgaacgccttccagccacctgagccctcctgcgggcgactcgctcagctagcccgtgcccgcctccaccttctccgtcatcccctcttccttgcgtccggctctccactggggctgcacagtcgagggctgctcgcgtcgggaaggagatgcccagagtctctggggcgcaccctcccgtcccgctcagccgcacccagctttagaaggtgctctcagcagccactttcgggctctagcgaggacaccctctcgcagaagtccttgccgagaccccccgccccagccattctctgaaggggctgaggacactcttatcgcgcccctcatggccaagcctcggctgctagttctctacttcgctctgattgtggttccggcctgggtgtccagcattgtcctcacagggacaagcgagcccccagatgcgcagacagtggcgcctgcggaggacgagactctgcaaaacgaggcggacaaccaggagaacgttttatctcagttgctgggggactatgacaaggtcaaggctatgtctgagggctcggactgtcagtgcaagtgtgtggtgagacccctgggccgggatgcctgccagaggatcaatgcgggggcctccaggaaggaagacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggtggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgctttttttttttaataaagaagaaatttaaaatca

SEQ ID NO: 161864 - DNA, 1153 bp, Homo sapiens
  Payload ID: 11595
  Gene Symbol: OLFML2B
  Gene Name: olfactomedin-like 2B
  Uniprot ID: Q68BL8
  ENST ID: ENST00000367938
  CDS Start-End: 330-1031
agaacaggagcaaagcatagtggtgtgaaagttgccaaagatgggcatggtggaggctcaagtgtagggtcaagtgtagggtggatcaggggagtagcaggagatggtgtggaaaaatgtttggggtcaggttatacagggctgttaaagcctgccgaggagtccagactctaaatggatgaacagcaaaggtttaaggggtgaggcatcactagatcagcccaaaacctccatccacctcttctccaccaggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataata

SEQ ID NO: 161865 - DNA, 2685 bp, Homo sapiens
  Payload ID: 11595
  Gene Symbol: OLFML2B
  Gene Name: olfactomedin-like 2B
  ENST ID: ENST00000367940
  CDS Start-End: 211-2466
acagtcgagggctgctcgcgtcgggaaggagatgcccagagtctctggggcgcaccctcccgtcccgctcagccgcacccagctttagaaggtgctctcagcagccactttcgggctctagcgaggacaccctctcgcagaagtccttgccgagaccccccgccccagccattctctgaaggggctgaggacactcttatcgcgcccctcatggccaagcctcggctgctagttctctacttcgctctgattgtggttccggcctgggtgtccagcattgtcctcacagggacaagcgagcccccagatgcgcagacagtggcgcctgcggaggacgagactctgcaaaacgaggcggacaaccaggagaacgttttatctcagttgctgggggactatgacaaggtcaaggctatgtctgagggctcggactgtcagtgcaagtgtgtggtgagacccctgggccgggatgcctgccagaggatcaatgcgggggcctccaggaaggaagacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagcagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggtggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatat

SEQ ID NO: 161866 - DNA, 559 bp, Homo sapiens
  Payload ID: 11595
  Gene Symbol: OLFML2B
  Gene Name: olfactomedin-like 2B
  ENST ID: ENST00000525589
  CDS Start-End: 1-267
acatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgctttttttttttaataaagaagaaatttaaaatc

SEQ ID NO: 161867 - DNA, 496 bp, Homo sapiens
  Payload ID: 11595
  Gene Symbol: OLFML2B
  Gene Name: olfactomedin-like 2B
  ENST ID: ENST00000533556
  CDS Start-End: 1-273
gagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggaggcaggcaacaccaggagcagaaatgaaagaggcaagaaagaagtgctatgtggcgagaaaaaaagttttaatgtattggagaagttttaaaaaacccagaaaaacgctttttttttttaataaagaagaaatttaaaatca

SEQ ID NO: 161868 - DNA, 1780 bp, Homo sapiens
  Payload ID: 11596
  Gene Symbol: OLFML3
  Gene Name: olfactomedin-like 3
  Uniprot ID: Q9NRN5
  ENST ID: ENST00000320334
  CDS Start-End: 75-1295
agctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgctc

SEQ ID NO: 161869 - DNA, 1934 bp, Homo sapiens
  Payload ID: 11596
  Gene Symbol: OLFML3
  Gene Name: olfactomedin-like 3
  Uniprot ID: Q9NRN5
  ENST ID: ENST00000369551
  CDS Start-End: 289-1449
aaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggttgagatccgtagcattttagtgtccgagaggataattgctaagggagcagagacctcttcacaccttcatgcgcttagacctgcctagaggctcagatggctcagtggcactgctcacagagaacacaggctggaggacatggagtcggggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgctc

SEQ ID NO: 161870 - DNA, 1961 bp, Homo sapiens
  Payload ID: 11596
  Gene Symbol: OLFML3
  Gene Name: olfactomedin-like 3
  ENST ID: ENST00000393300
  CDS Start-End: 439-1476
gagagagacccagagatcaggagagaaggcaccgcccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggagtggaaggggatattgaagcctggctgagtttgctctttttttcccattcctgactcccgagttgggcctctccctgcctgggagttgtaaccctgcagcctccctcctgatcccccatcccttcaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgctc

SEQ ID NO: 161871 - DNA, 492 bp, Homo sapiens
  Payload ID: 11597
  Gene Symbol: OMP
  Gene Name: olfactory marker protein
  Uniprot ID: P47874
  ENST ID: ENST00000529803
  CDS Start-End: 1-492
atggcggaggacaggccgcagcagccgcagctggacatgccgctggtcctggaccagggcctgaccaggcagatgcggctacgcgtggagagcctgaagcagcgcggggagaagcgccaggatggggagaagctgctgcagccagcggagtctgtgtaccgcctcaacttcacccagcagcagcggctacagttcgagcgctggaatgtcgtgctggacaagccgggcaaggtcaccatcacaggcacctcgcagaactggacgcctgacctcaccaacctcatgacacgccagctgctggaccccactgccatcttctggcgcaaggaggactcggatgccatagattggaatgaggccgacgccctggagtttggggagcgcctgtcggacctggccaagatccgcaaggtcatgtacttcctcgtcacctttggcgagggtgtggagcccgccaacctcaaggcctccgtggtttttaaccagctctga

SEQ ID NO: 161872 - DNA, 1030 bp, Homo sapiens
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENST ID: ENST00000622207
  CDS Start-End: 1-945
atggaaagacaaaatcaaagctgtgtggttgaattcatcctcttgggcttttctaactatcctgagctccaggggcagctctttgtggctttcctggttatttatctggtgaccctgataggaaatgccattattatagtcatcgtctccctagaccagagcctccacgttcccatgtacctgtttctcctgaacttatctgtggtggacctgagtttcagtgcagttattatgcctgaaatgctggtggtcctctctactgaaaaaactacaatttcttttgggggctgttttgcacagatgtatttcatccttctttttggtggggctgaatgttttcttctgggagcaatggcttatgaccgatttgctgcaatttgccatcctctcaactaccaaatgattatgaataaaggagtttttatgaaattaattatattttcatgggccttaggttttatgttaggtactgttcaaacatcatgggtatctagttttcccttttgtggccttaatgaaattaaccatatatcttgtgaaaccccagcagtgttagaacttgcatgtgcagacacgtttttgtttgaaatctatgcattcacaggcacctttttgattattttggttcctttcttgttgatactcttgtcttacattcgagttctgtttgccatcctgaagatgccatcaaccactgggagacaaaaggccttttccacctgtgccgctcacctcacatctgtgaccctattctatggcacagccagtatgacttatttacaacccaaatctggctactcaccggaaaccaagaaagtgatgtcattgtcttactcacttctgacaccactgctgaatctgcttatctacagtttgcgaaatagtgagatgaagagggctttgatgaaattatggcgaaggcgagtggttttacacacaatctgactgtgttgagaagccatgtaagatttagtcactgcatgactgtattcaatctaaatttaataaatttagattcattaagtttgca

SEQ ID NO: 161873 - DNA, 1030 bp, Homo sapiens; identical to SEQ ID NO: 161872
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENST ID: ENST00000623991
  CDS Start-End: 1-945

SEQ ID NO: 161874 - DNA, 945 bp, Homo sapiens
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENST ID: ENST00000623813
  CDS Start-End: 1-945
atggaaagacaaaatcaaagctgtgtggttgaattcatcctcttgggcttttctaactatcctgagctccaggggcagctctttgtggctttcctggttatttatctggtgaccctgataggaaatgccattattatagtcatcgtctccctagaccagagcctccacgttcccatgtacctgtttctcctgaacttatctgtggtggacctgagtttcagtgcagttattatgcctgaaatgctggtggtcctctctactgaaaaaactacaatttcttttgggggctgttttgcacagatgtatttcatccttctttttggtggggctgaatgttttcttctgggagcaatggcttatgaccgatttgctgcaatttgccatcctctcaactaccaaatgattatgaataaaggagtttttatgaaattaattatattttcatgggccttaggttttatgttaggtactgttcaaacatcatgggtatctagttttcccttttgtggccttaatgaaattaaccatatatcttgtgaaaccccagcagtgttagaacttgcatgtgcagacacgtttttgtttgaaatctatgcattcacaggcacctttttgattattttggttcctttcttgttgatactcttgtcttacattcgagttctgtttgccatcctgaagatgccatcaaccactgggagacaaaaggccttttccacctgtgccgctcacctcacatctgtgaccctattctatggcacagccagtatgacttatttacaacccaaatctggctactcaccggaaaccaagaaagtgatgtcattgtcttactcacttctgacaccactgctgaatctgcttatctacagtttgcgaaatagtgagatgaagagggctttgatgaaattatggcgaaggcgagtggttttacacacaatctga

SEQ ID NO: 161875 - DNA, 945 bp, Homo sapiens; identical to SEQ ID NO: 161874
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENST ID: ENST00000626590
  CDS Start-End: 1-945

SEQ ID NO: 161876 - DNA, 1030 bp, Homo sapiens; identical to SEQ ID NO: 161872
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENST ID: ENST00000625231
  CDS Start-End: 1-945

SEQ ID NO: 161877 - DNA, 945 bp, Homo sapiens; identical to SEQ ID NO: 161874
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENST ID: ENST00000629539
  CDS Start-End: 1-945

SEQ ID NO: 161878 - DNA, 981 bp, Homo sapiens
  Payload ID: 11599
  Gene Symbol:
  Gene Name: Olfactory receptor 10X1  [Source:UniProtKB/Swiss-Prot
  Acc:Q8NGY0]
  Uniprot ID: Q8NGY0
  ENST ID: ENST00000625122
  CDS Start-End: 1-981
atggtgttgaatgtttattgttgtttctttcaaatttcagacattcaaacgatgaagatcaaccagacaatcctgaaggaattcattcttgttggcttttctgtgtacccacatgtacagacatttctttttgtggtcttcttttgtctctaccttctcacccttgcaggtaatctgatcatcatgggtctaacttgggtggacaggtccctccacacccctatgtatctcttccttagtgcactctccttctctgagacctgctatacgctgaccatcgtccccaagatgctggaagatctactggccaaggacagaagcatttcagtcacaggttgtagcttacagatgtgcttcttcttgggacttggtggcacaaactgtatcattctcactttgatgggatatgaccgcttcctggccatctgtaaccctctaagatatccactgcttatgaccaacattgtatgtggacaacttgtggcctctgcttgcactgcaggcttctttatctctcttacagagactgcactgatattcagggactctttctgcagacccaaccttgtcaaacacttcttctgccatatgctggcagttattaggctgtcttgtatagacagtaaccacacagaattcattataacactgatctcagtgtctggtttgctgggtacccttctgctcatcatcctgactgatgtcttcattatttctactgtcctcaggatcccttcagctgagggcaagcagaaggccttcaccacctgtgcctcccacctcaccgtggttataatccactttggttttgcatctattgtttatttgaagccagaagcctcaggagatgacacactcatagcagtcccttatactgtcattacccccttcctcagccccatcatattcagcctgaggaataaggacatgaaaaatgcttttagaagaatgatgggaaacacagttgccttgaaaaaataa

SEQ ID NO: 161879 - DNA, 981 bp, Homo sapiens; identical to SEQ ID NO: 161878
  Payload ID: 11599
  Gene Symbol:
  Gene Name: Olfactory receptor 10X1  [Source:UniProtKB/Swiss-Prot
  Acc:Q8NGY0]
  Uniprot ID: Q8NGY0
  ENST ID: ENST00000623167
  CDS Start-End: 1-981

SEQ ID NO: 161880 - DNA, 1072 bp, Homo sapiens
  Payload ID: 11600
  Gene Symbol:
  Gene Name: Olfactory receptor 2T11  [Source:UniProtKB/Swiss-Prot
  Acc:Q8NH01]
  Uniprot ID: Q8NH01
  ENST ID: ENST00000625160
  CDS Start-End: 63-1013
tcttgcctccttcctggtccttgtgtcttcccgttgccctgggacgctcgtgggccatatcaatgacgaacacatcatcctctgacttcaccctcctggggcttctggtgaacagtgaggctgccgggattgtatttacagtgatccttgctgttttcttgggggccgtgactgcaaatttggtcatgatattcttgattcaggtggactctcgcctccacacccccatgtactttctgctcagtcagctgtccatcatggacacccttttcatctgtaccactgtcccaaaactcctggcagacatggtttctaaagagaagatcatttcctttgtggcctgtggcatccagatcttcctctacctgaccatgattggttctgagttcttcctcctgggcctcatggcctatgactgctacgtggctgtctgtaaccctctgagatacccagtcctgatgaaccgcaagaagtgtcttttgctggctgctggtgcctggtttgggggctccctcgatggctttctgctcactcccatcaccatgaatgtcccttactgtggctcccgaagtatcaaccattttttctgtgagatcccagcagttctgaaactggcctgtgcagacacgtccttgtatgaaactctgatgtacatctgctgtgtcctcatgttgctcatccccatctctatcatctccacttcctactccctcatcttgttaaccatccaccgcatgccctctgctgaaggtcgcaaaaaggccttcaccacttgttcctcccacttgactgtagttagcatcttctatggggctgccttctacacatacgtgctgccccagtccttccacacccccgagcaggacaaagtagtgtcagccttctataccattgtcacgcccatgcttaatcctctcatctacagcctcagaaacaaggacgtcataggggcatttaaaaaggtatttgcatgttgctcatctgctcagaaagtagcaacaagtgatgcttagagagtcactgcccagaggataaggcttcctaaggacttcctccatttgccctgtttccc

SEQ ID NO: 161881 - DNA, 951 bp, Homo sapiens
  Payload ID: 11600
  Gene Symbol:
  Gene Name: Olfactory receptor 2T11  [Source:UniProtKB/Swiss-Prot
  Acc:Q8NH01]
  Uniprot ID: Q8NH01
  ENST ID: ENST00000625105
  CDS Start-End: 1-951
atgacgaacacatcatcctctgacttcaccctcctggggcttctggtgaacagtgaggctgccgggattgtatttacagtgatccttgctgttttcttgggggccgtgactgcaaatttggtcatgatattcttgattcaggtggactctcgcctccacacccccatgtactttctgctcagtcagctgtccatcatggacacccttttcatctgtaccactgtcccaaaactcctggcagacatggtttctaaagagaagatcatttcctttgtggcctgtggcatccagatcttcctctacctgaccatgattggttctgagttcttcctcctgggcctcatggcctatgactgctacgtggctgtctgtaaccctctgagatacccagtcctgatgaaccgcaagaagtgtcttttgctggctgctggtgcctggtttgggggctccctcgatggctttctgctcactcccatcaccatgaatgtcccttactgtggctcccgaagtatcaaccattttttctgtgagatcccagcagttctgaaactggcctgtgcagacacgtccttgtatgaaactctgatgtacatctgctgtgtcctcatgttgctcatccccatctctatcatctccacttcctactccctcatcttgttaaccatccaccgcatgccctctgctgaaggtcgcaaaaaggccttcaccacttgttcctcccacttgactgtagttagcatcttctatggggctgccttctacacatacgtgctgccccagtccttccacacccccgagcaggacaaagtagtgtcagccttctataccattgtcacgcccatgcttaatcctctcatctacagcctcagaaacaaggacgtcataggggcatttaaaaaggtatttgcatgttgctcatctgctcagaaagtagcaacaagtgatgcttag

SEQ ID NO: 161882 - DNA, 933 bp, Homo sapiens
  Payload ID: 11601
  Gene Symbol:
  Gene Name: Olfactory receptor 4C16  [Source:UniProtKB/Swiss-Prot
  Acc:Q8NGL9]
  Uniprot ID: Q8NGL9
  ENST ID: ENST00000623907
  CDS Start-End: 1-933
atgcaactgaataataatgtgactgagttcattctgcttggattgacacaggatcctttttggaagaaaatagtgtttgttatttttttgcgtctctacttgggaacactgttgggtaatttgctaatcattattagtgtcaagaccagccaggcacttaagaacccaatgttcttcttccttttctacttatccttatctgatacttgcctctctacttccataacccctagaatgattgtggatgcccttttgaagaagacaactatctccttcagcgagtgcatgatccaagtcttttcatcccatgtctttggctgcctggagatcttcatcctcatcctcacggctgttgaccgctatgtggacatctgtaagcccctgcactacatgaccatcataagccagtgggtctgtggtgttttgatggctgtggcctgggtgggatcctgtgtgcattctttagttcagatttttcttgccctgagtttgccattctgtggccccaatgtgatcaatcactgtttctgtgacttgcagcccttgttgaaacaagcctgttcagaaacctatgtggttaacctactcctggtttccaatagtggggccatttgtgcagtgagttatgtcatgctaatattctcctatgtcatcttcttgcattctctgagaaaccacagtgctgaagtgataaagaaagcactttccacatgtgtctcccacatcattgtggtcatcttgttctttggaccttgcatatttatgtacacatgccttgcaaccgtattccccatggataagatgatagctgtattttatacagttggaacatcttttctcaaccctgtgatttacacgctgaagaatacagaagtgaaaagtgccatgaggaagctttggagcaagaaattgatcacagatgacaaaagataa

SEQ ID NO: 161883 - DNA, 933 bp, Homo sapiens; identical to SEQ ID NO: 161882
  Payload ID: 11601
  Gene Symbol:
  Gene Name: Olfactory receptor 4C16  [Source:UniProtKB/Swiss-Prot
  Acc:Q8NGL9]
  Uniprot ID: Q8NGL9
  ENST ID: ENST00000624571
  CDS Start-End: 1-933

SEQ ID NO: 161884 - DNA, 1084 bp, Homo sapiens
  Payload ID: 11602
  Gene Symbol:
  Gene Name: Olfactory receptor 4M2  [Source:UniProtKB/Swiss-Prot
  Acc:Q8NGB6]
  Uniprot ID: Q8NGB6
  ENST ID: ENST00000332663
  CDS Start-End: 99-1040
ttttgaaagcagtgatataactctaggtaaatgctatgtctactaattatagtttcttaattttcatagctatattatgaaaagagtaaattgaagaaatggaaactgcaaattacaccaaggtgacagaatttgttctcactggcctatcccagactccagaggtccaactagtcctatttgttatatttctatccttctatttgttcatcctaccaggaaatatccttatcatttgcaccatcagtctagaccctcatctgacctctcctatgtatttcctgttggctaatctggccttccttgatatttggtactcttccattacagcccctgaaatgctcatagacttctttgtggagaggaagataatttcttttgatgaatgcattgcacagctcttcttcttacactttgctggggcttcagagatgttcttgctcacagtgatggcctttgacctctacactgctatctgccgacccctccactatgctaccatcatgaatcaacgtctctgctgtatcctggtggctctctcctggagggggggcttcattcattctatcatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttgattgctctgttaatgtcctatgccttccttctggccttgctcaagaaactttcaggctcaggtgagaataccaacagggccgtgtccacctgctattcccacattaccattgtggtgctaatgtttgggccatccatctacatttatgctcgcccatttgactcgttttccctagataaagtggtgtctgtgttcaatactttaatattccctttacataatcccattatttacacattgagaaacaaggaagtaaaggcagccatgaggaagttggtcaccaaatatattttgtgtaaagagaagtgaaagataaattatacattttatagttcccctgaggatcattgtcc

SEQ ID NO: 161885 - DNA, 1015 bp, Homo sapiens
  Payload ID: 11603
  Gene Symbol:
  Gene Name: Olfactory receptor 4X2  [Source:UniProtKB/Swiss-Prot
  Acc:Q8NGF9]
  Uniprot ID: Q8NGF9
  ENST ID: ENST00000302329
  CDS Start-End: 49-960
cccaaattgctgcctcttgatgatgacctcttggctaacatacacaacatgactgaattcatttttctggtactttctcccaaccaggaggtgcagagggtttgctttgtgatatttctgttcttgtacacagcaattgtgctggggaatttcctcattgtgctcactgtcatgaccagcagaagccttggttcccccatgtacttcttcctcagctacctctccttcatggagatctgctactcctccgctacagcccccaaactcatctcagatctgctggctgaaaggaaagtcatatcttggtggggctgcatggcacagcttttcttcttgcacttctttggtggcactgagattttcctgctcactgtgatggcctatgaccactatgtggccatctgcaagcccctcagctacaccaccatcatgaactggcaggtgtgtactgtccttgtaggaatagcatgggtgggaggcttcatgcattcctttgcacaaatccttctcatcttccacctgctcttctgtggccccaatgtgatcaatcactatttctgtgacctagttccccttctcaaacttgcctgctctgacaccttcctcattggtctgctgattgttgccaatggaggcaccctgtctgtgatcagttttggggtcctcttagcatcctatatggtcatcttgctccatctgagaacctggagctctgaagggtggtgcaaagccctctccacctgtgggtcccatttcgctgtggttatcttgttctttgggccctgcgtcttcaactctctgaggccttctaccactctgcccatagacaagatggtggctgtgttctacacagtgataaccgcgatcctgaaccctgtcatctactctctgagaaatgctgaaatgaggaaggccatgaagaggctgtggattaggacattgagactaaatgagaaatagaggctgagtctttgtattgatacttgggtttagaatgactgttgagtccaaactg

SEQ ID NO: 161886 - DNA, 1025 bp, Homo sapiens
  Payload ID: 11603
  Gene Symbol:
  Gene Name: Olfactory receptor 4X2  [Source:UniProtKB/Swiss-Prot
  Acc:Q8NGF9]
  Uniprot ID: Q8NGF9
  ENST ID: ENST00000624868
  CDS Start-End: 49-960
cccaaattgctgcctcttgatgatgacctcttggctaacatacacaacatgactgaattcatttttctggtactttctcccaaccaggaggtgcagagggtttgctttgtgatatttctgttcttgtacacagcaattgtgctggggaatttcctcattgtgctcactgtcatgaccagcagaagccttggttcccccatgtacttcttcctcagctacctctccttcatggagatctgctactcctccgctacagcccccaaactcatctcagatctgctggctgaaaggaaagtcatatcttggtggggctgcatggcacagcttttcttcttgcacttctttggtggcactgagattttcctgctcactgtgatggcctatgaccactatgtggccatctgcaagcccctcagctacaccaccatcatgaactggcaggtgtgtactgtccttgtaggaatagcatgggtgggaggcttcatgcattcctttgcacaaatccttctcatcttccacctgctcttctgtggccccaatgtgatcaatcactatttctgtgacctagttccccttctcaaacttgcctgctctgacaccttcctcattggtctgctgattgttgccaatggaggcaccctgtctgtgatcagttttggggtcctcttagcatcctatatggtcatcttgctccatctgagaacctggagctctgaagggtggtgcaaagccctctccacctgtgggtcccatttcgctgtggttatcttgttctttgggccctgcgtcttcaactctctgaggccttctaccactctgcccatagacaagatggtggctgtgttctacacagtgataaccgcgatcctgaaccctgtcatctactctctgagaaatgctgaaatgaggaaggccatgaagaggctgtggattaggacattgagactaaatgagaaatagaggctgagtctttgtattgatacttgggtttagaatgactgttgagtccaaactgaaggagcaga

SEQ ID NO: 161887 - DNA, 960 bp, Homo sapiens
  Payload ID: 11604
  Gene Symbol:
  Gene Name: Olfactory receptor 51F1  [Source:UniProtKB/Swiss-Prot
  Acc:A6NGY5]
  Uniprot ID: A6NGY5
  ENST ID: ENST00000380383
  CDS Start-End: 1-960
atgctgcaaaaccaggacaccatggaaatcctaagcaactcaacatctaaatttccaaccttcttgttgaccggcattcctggcctagagtctgcccatgtctggatctccattcctttctgttgtttttatgccattgccctctctgggaacagcgtgatcctgtttgtcatcattacccagcagagtctccatgaacccatgtattatttcctcttcaggctatcagccactgatctgggcttgactgtttcttcattgtcaacaacattaggtatcctctggtttgaggcacgtgaaatcagtctatatagctgcattgtccagatgttttttcttcatggattcacttttatggaatctggagtgctggtggctacagcctttgaccgttatgtggccatctgtgaccctctgaggtacactaccattctcactaattccagaatcattcaaatgggtcttctgatgattacacgtgctatagtactaatattgccactacttttgctccttaagcctctctatttctgtagaatgaatgccctttctcactcctattgttaccatccagatgtgattcaattagcatgttcagacattcgggcaaatagcatctgtggattaattgatctcatcctgaccactggaatagatacaccatgcattgtcctgtcatatatcttaattattcactctgtcctcagaattgcctcccctgaagaatggcacaaggtcttcagcacctgtgtctcccatgtgggagcagttgctttcttctacatccacatgctgagcctgtccttggtgtatcgctatggtcggtcagcccccagagtagtccattcagtgatggctaatgtatacctgcttttaccccctgtgctcaaccccatcatcgacagtgtaaaaacaaaacaaatccgcaaggctatgctcagtctgctgcttacaaaatga

SEQ ID NO: 161888 - DNA, 939 bp, Homo sapiens
  Payload ID: 11604
  Gene Symbol:
  Gene Name: Olfactory receptor 51F1  [Source:UniProtKB/Swiss-Prot
  Acc:A6NGY5]
  ENST ID: ENST00000624103
  CDS Start-End: 1-939
atggaaatcctaagcaactcaacatctaaatttccaaccttcttgttgaccggcattcctggcctagagtctgcccatgtctggatctccattcctttctgttgtttttatgccattgccctctctgggaacagcgtgatcctgtttgtcatcattacccagcagagtctccatgaacccatgtattatttcctcttcaggctatcagccactgatctgggcttgactgtttcttcattgtcaacaacattaggtatcctctggtttgaggcacgtgaaatcagtctatatagctgcattgtccagatgttttttcttcatggattcacttttatggaatctggagtgctggtggctacagcctttgaccgttatgtggccatctgtgaccctctgaggtacactaccattctcactaattccagaatcattcaaatgggtcttctgatgattacacgtgctatagtactaatattgccactacttttgctccttaagcctctctatttctgtagaatgaatgccctttctcactcctattgttaccatccagatgtgattcaattagcatgttcagacattcgggcaaatagcatctgtggattaattgatctcatcctgaccactggaatagatacaccatgcattgtcctgtcatatatcttaattattcactctgtcctcagaattgcctcccctgaagaatggcacaaggtcttcagcacctgtgtctcccatgtgggagcagttgctttcttctacatccacatgctgagcctgtccttggtgtatcgctatggtcggtcagcccccagagtagtccattcagtgatggctaatgtatacctgcttttaccccctgtgctcaaccccatcatcgacagtgtaaaaacaaaacaaatccgcaaggctatgctcagtctgctgcttacaaaatga

SEQ ID NO: 161889 - DNA, 948 bp, Homo sapiens
  Payload ID: 11605
  Gene Symbol:
  Gene Name: Olfactory receptor 52R1  [Source:UniProtKB/Swiss-Prot
  Acc:Q8NGF1]
  Uniprot ID: Q8NGF1
  ENST ID: ENST00000624978
  CDS Start-End: 1-948
atggtgctggcttcagggaacagctcttctcatcctgtgtccttcatcctgcttggaatcccaggcctggagagtttccagttgtggattgcctttccgttctgtgccacgtatgctgtggctgttgttggaaatatcactctcctccatgtaatcagaattgaccacaccctgcatgagcccatgtacctctttctggccatgctggccatcactgacctggtcctctcctcctccactcaacctaagatgttggccatattctggtttcatgctcatgagattcagtaccatgcctgcctcatccaggtgttcttcatccatgccttttcttctgtggagtctggggtgctcatggctatggccctggactgctacgtggctatctgcttcccactccgacactctagcatcctgaccccatcggtcgtgatcaaactggggaccatcgtgatgctgagagggctgctgtgggtgagccccttctgcttcatggtgtctaggatgcccttctgccaacaccaagccattccccagtcatactgtgagcacatggctgtgctgaagttggtgtgtgctgatacaagcataagtcgtgggaatgggctctttgtggccttctctgtggctggctttgatatgattgtcattggtatgtcatacgtgatgattttgagagctgtgcttcagttgccctcaggtgaagcccgcctcaaagcttttagcacacgttcctcccatatctgtgtcatcttggctctttatatcccagcccttttttctttcctcacctaccgctttggccatgatgtgccccgagttgtacacatcctgtttgctaatctctatctactgatacctcccatgctcaaccccatcatttatggagttagaaccaaacagatcggggacagggttatccaaggatgttgtggaaacatcccctga

SEQ ID NO: 161890 - DNA, 948 bp, Homo sapiens; identical to SEQ ID NO: 161889
  Payload ID: 11605
  Gene Symbol:
  Gene Name: Olfactory receptor 52R1  [Source:UniProtKB/Swiss-Prot
  Acc:Q8NGF1]
  Uniprot ID: Q8NGF1
  ENST ID: ENST00000624198
  CDS Start-End: 1-948

SEQ ID NO: 161891 - DNA, 1026 bp, Homo sapiens
  Payload ID: 11606
  Gene Symbol:
  Gene Name: Olfactory receptor 5AR1  [Source:UniProtKB/Swiss-Prot
  Acc:Q8NGP9]
  Uniprot ID: Q8NGP9
  ENST ID: ENST00000302969
  CDS Start-End: 25-957
ccaggcacacatacacttgaagcaatggataaagaaaacagctcaatggtgactgagtttatcttcatgggcatcacccaggaccctcagatggagatcatcttcttcgtggtcttcctcatagtttacctggttaatgtagtggggaatattggtatgattatcctgattacaacagacactcagcttcacacacccatgtattttttcctctgcaacctctcctttgttgacctgggctactcctcagccattgcccccaggatgctggctgacttcctaacaaatcacaaagttatctccttctccagctgtgccacccagtttgctttttttgtaggttttgtggatgctgagtgctatgtcctggcagccatggcctatggtcgttttgtggccatttgtcgacccctccactatagcaccttcatgtccaagcaggtctgcttggctctcatgctgggctcttacctggctggtctagtgagtttagtagcccacactaccctcaccttcagcctgagttactgtggttccaatatcatcaatcatttcttctgcgaaatcccaccactcttggccctctcttgctcagacacctacatcagtgagatcttgctcttcagtctgtgtggcttcattgaattcagcaccatcctcatcatcttcatctcctatacctttatccttgttgcaatcatcagaatgcgttcagctgaaggccgccttaaggctttctccacctgcgggtctcaccttactggcatcaccctcttctatggcacagtcatgtttatgtacctgaggccaacatccagctactccctggaccaagacaagtgggcctctgtgttctacacggttatcatccccatgttaaatcccttgatctacagtttgcggaacaaggatgtgaaagctgctttcaaaaagctaattggaaaaaaatctcaataataacacaaaatgaaaatctgtttctgtcataggtaaatgacagtagtagaagggcatagaaaatgcaaa

SEQ ID NO: 161892 - DNA, 1026 bp, Homo sapiens; identical to SEQ ID NO: 161891
  Payload ID: 11606
  Gene Symbol:
  Gene Name: Olfactory receptor 5AR1  [Source:UniProtKB/Swiss-Prot
  Acc:Q8NGP9]
  Uniprot ID: Q8NGP9
  ENST ID: ENST00000624596
  CDS Start-End: 25-957

SEQ ID NO: 161893 - DNA, 936 bp, Homo sapiens
  Payload ID: 11607
  Gene Symbol:
  Gene Name: Olfactory receptor 5L1  [Source:UniProtKB/Swiss-Prot
  Acc:Q8NGL2]
  Uniprot ID: Q8NGL2
  ENST ID: ENST00000625203
  CDS Start-End: 1-936
atgggcaaggaaaactgcaccactgtggctgagttcattctccttggactatcagatgtccctgagttgagagtctgcctcttcctgctgttccttctcatctatggagtcacgttgttagccaacctgggcatgattgcactgattcaggtcagctctcggctccacacccccatgtactttttcctcagccacttgtcctctgtagatttctgctactcctcaataattgtgccaaaaatgttggctaatatctttaacaaggacaaagccatctccttcctagggtgcatggtgcaattctacttgttttgcacttgtgtggtcactgaggtcttcctgctggccgtgatggcctatgaccgctttgtggccatctgtaaccctttgctatacacagtcaccatgtcttggaaggtgcgtgtggagctggcttcttgctgctacttctgtgggacggtgtgttctctgattcatttgtgcttagctcttaggatccccttctatagatctaatgtgattaaccactttttctgtgatctacctcctgtcttaagtcttgcttgctctgatatcactgtgaatgagacactgctgttcctggtggccactttgaatgagagtgttaccatcatgatcatcctcacctcctacctgctaattctcaccaccatcctgaagatgggctctgcagagggcaggcacaaagccttctccacctgtgcttcccacctcacagctatcactgtcttccatggaacagtcctttccatttattgcaggcccagttcaggcaatagtggagatgctgacaaagtggccaccgtgttctacacagtcgtgattcctatgctgaactctgtgatctacagcctgagaaataaagatgtgaaagaagctctcagaaaagtgatgggctccaaaattcactcctag

SEQ ID NO: 161894 - DNA, 1110 bp, Homo sapiens
  Payload ID: 11607
  Gene Symbol:
  Gene Name: Olfactory receptor 5L1  [Source:UniProtKB/Swiss-Prot
  Acc:Q8NGL2]
  Uniprot ID: Q8NGL2
  ENST ID: ENST00000623450
  CDS Start-End: 101-1036
ggtgtctttttacaggatacagccaaaactaaaatttagactatataatggagaataatttttaagtttcttttcctccaatctcatataaattggagacatgggcaaggaaaactgcaccactgtggctgagttcattctccttggactatcagatgtccctgagttgagagtctgcctcttcctgctgttccttctcatctatggagtcacgttgttagccaacctgggcatgattgcactgattcaggtcagctctcggctccacacccccatgtactttttcctcagccacttgtcctctgtagatttctgctactcctcaataattgtgccaaaaatgttggctaatatctttaacaaggacaaagccatctccttcctagggtgcatggtgcaattctacttgttttgcacttgtgtggtcactgaggtcttcctgctggccgtgatggcctatgaccgctttgtggccatctgtaaccctttgctatacacagtcaccatgtcttggaaggtgcgtgtggagctggcttcttgctgctacttctgtgggacggtgtgttctctgattcatttgtgcttagctcttaggatccccttctatagatctaatgtgattaaccactttttctgtgatctacctcctgtcttaagtcttgcttgctctgatatcactgtgaatgagacactgctgttcctggtggccactttgaatgagagtgttaccatcatgatcatcctcacctcctacctgctaattctcaccaccatcctgaagatgggctctgcagagggcaggcacaaagccttctccacctgtgcttcccacctcacagctatcactgtcttccatggaacagtcctttccatttattgcaggcccagttcaggcaatagtggagatgctgacaaagtggccaccgtgttctacacagtcgtgattcctatgctgaactctgtgatctacagcctgagaaataaagatgtgaaagaagctctcagaaaagtgatgggctccaaaattcactcctagggaagattttattagcacaattcaggattcccaagtagtggcaggcgggggttcacgggagaggcacagtgttg

SEQ ID NO: 161895 - DNA, 975 bp, Homo sapiens
  Payload ID: 11608
  Gene Symbol:
  Gene Name: Olfactory receptor 5R1  [Source:UniProtKB/Swiss-Prot
  Acc:Q8NH85]
  Uniprot ID: Q8NH85
  ENST ID: ENST00000623216
  CDS Start-End: 1-975
atggctgaagttaatatcatttatgtcactgtattcattctgaaaggaattaccaaccggccagagcttcaggccccgtgctttggggtgtttttagttatctatctggtcacagtgctgggcaatcttgggttgattactttaatcaagattgatactcgactccacacacctatgtactatttcctcagccacctggcctttgttgacctttgttactcctctgctattacaccgaagatgatggtgaattttgttgtggaacgcaacaccattcctttccatgcttgtgcaacccaactgggttgttttctcaccttcatgatcactgagtgtttccttctagcctccatggcctacgattgctatgtcgccatctgtagtcccctgcattattcaacactgatgtcaagaagagtctgcattcaactggtggcagttccatatatatacagcttcctggttgccctcttccacaccgttatcactttccgtctgacttactgtggcccaaacttaattaaccatttctattgtgatgacctccccttcttagctctgtcctgctcagacacacacatgaaggaaattctgatatttgcctttgctggctttgatatgatctcttcctcttccattgtcctcacctcctacatctttattattgccgctatcctaaggatccgctctactcaggggcaacacaaagccatttccacctgtggctcccatatggtgactgtcactattttctatggcacactgatctttatgtacctacagcccaaatcaaatcactccttggacacagacaagatggcttctgtattttacacagtggtgatccccatgttaaaccccctaatctatagtctaaggaacaaagaagtgaaagatgcctcaaagaaagccttggataaaggttgtgaaaacttacagatattaacatttttaaaaataagaaaactttattaa

SEQ ID NO: 161896 - DNA, 975 bp, Homo sapiens; identical to SEQ ID NO: 161895
  Payload ID: 11608
  Gene Symbol:
  Gene Name: Olfactory receptor 5R1  [Source:UniProtKB/Swiss-Prot
  Acc:Q8NH85]
  Uniprot ID: Q8NH85
  ENST ID: ENST00000623286
  CDS Start-End: 1-975

SEQ ID NO: 161897 - DNA, 1002 bp, Homo sapiens
  Payload ID: 11609
  Gene Symbol:
  Gene Name: Olfactory receptor 6Q1  [Source:UniProtKB/Swiss-Prot
  Acc:Q8NGQ2]
  Uniprot ID: Q8NGQ2
  ENST ID: ENST00000302622
  CDS Start-End: 24-977
ttgctgagctctcactgccacatatgcaaccatataccaaaaactggacccaggtaactgaatttgtcatgatgggctttgctggcatccatgaagcacacctcctcttcttcatactcttcctcaccatgtacctgttcaccttggtggagaatttggccatcattttagtggtgggtttggaccaccgactacggagacccatgtatttcttcctgacacacttgtcctgccttgaaatctggtacacttctgttacagtgcccaagatgctggctggttttattggggtggatggtggcaagaatatctcttatgctgattgcctatcccagctcttcatcttcacctttcttggggcaactgagtgtttcctactggctgccatggcctatgatcgttatgtggccatttgtatgcctctccactatggggcttttgtgtcctggggcacctgcatccgtctggcagctgcctgttggctggtaggtttcctcacacccatcttgccaatctacctcttgtctcagctaacattttatggcccaaatgtcattgaccatttctcctgtgatgcctcacccttgctagccttgtcgtgctcagatgtcacttggaaggagactgtggatttcctggtgtctctggctgtgctactggcctcctctatggtcattgctgtgtcctatggcaacatcgtctggacactgctgcacatccgctcagctgctgagcgctggaaggccttctctacctgtgcagctcacctgactgtggtgagcctcttctatggcactcttttctttatgtatgtccagaccaaggtgacctcctccatcaacttcaacaaggtggtatctgtcttctactctgttgtcacgcccatgctcaatcctctcatctacagtcttaggaacaaggaagtgaagggagctctgggtcgagtcttttctctcaacttttggaagggacagtgaggaggcaggtgggaacccagtttcc

SEQ ID NO: 161898 - DNA, 1002 bp, Homo sapiens; identical to SEQ ID NO: 161897
  Payload ID: 11609
  Gene Symbol:
  Gene Name: Olfactory receptor 6Q1  [Source:UniProtKB/Swiss-Prot
  Acc:Q8NGQ2]
  Uniprot ID: Q8NGQ2
  ENST ID: ENST00000623396
  CDS Start-End: 24-977

SEQ ID NO: 161899 - DNA, 983 bp, Homo sapiens
  Payload ID: 11610
  Gene Symbol:
  Gene Name: Olfactory receptor 8B4  [Source:UniProtKB/Swiss-Prot
  Acc:Q96RC9]
  Uniprot ID: Q96RC9
  ENST ID: ENST00000356130
  CDS Start-End: 23-952
ccagacagctcgccaagagagaatgactctgagaaacagctcctcagtgactgagtttatccttgtgggattatcagaacagccagagctccagctccctcttttccttctattcttagggatctatgtgttcactgtggtgggcaacttgggcttgatcaccttaattgggataaatcctagccttcacacccccatgtactttttcctcttcaacttgtcctttatagatctctgttattcctgtgtgtttacccccaaaatgctgaatgactttgtttcagaaagtatcatctcttatgtgggatgtatgactcagctatttttcttctgtttctttgtcaattctgagtgctatgtgttggtatcaatggcctatgatcgctatgtggccatctgcaaccccctgctctacatggtcaccatgtccccaagggtctgctttctgctgatgtttggttcctatgtggtagggtttgctggggccatggcccacactggaagcatgctgcgactgaccttctgtgattccaacgtcattgaccattatctgtgtgacgttctccccctcttgcagctctcctgcaccagcacccatgtcagtgagctggtatttttcattgttgttggagtaatcaccatgctatccagcataagcatcgtcatctcttacgctttgatactctccaacatcctctgtattccttctgcagagggcagatccaaagcctttagcacatggggctcccacataattgctgttgctctgttttttgggtcagggacattcacctacttaacaacatcttttcctggctctatgaaccatggcagatttgcctcagtcttttacaccaatgtggttcccatgcttaacccttcgatctacagtttgaggaataaggatgataaacttgccctgggcaaaaccctgaagagagtgctcttctaatgggtctcttcatatcactggcaaccgattc

SEQ ID NO: 161900 - DNA, 990 bp, Homo sapiens
  Payload ID: 11610
  Gene Symbol:
  Gene Name: Olfactory receptor 8B4  [Source:UniProtKB/Swiss-Prot
  Acc:Q96RC9]
  Uniprot ID: Q96RC9
  ENST ID: ENST00000624217
  CDS Start-End: 23-952
ccagacagctcgccaagagagaatgactctgagaaacagctcctcagtgactgagtttatccttgtgggattatcagaacagccagagctccagctccctcttttccttctattcttagggatctatgtgttcactgtggtgggcaacttgggcttgatcaccttaattgggataaatcctagccttcacacccccatgtactttttcctcttcaacttgtcctttatagatctctgttattcctgtgtgtttacccccaaaatgctgaatgactttgtttcagaaagtatcatctcttatgtgggatgtatgactcagctatttttcttctgtttctttgtcaattctgagtgctatgtgttggtatcaatggcctatgatcgctatgtggccatctgcaaccccctgctctacatggtcaccatgtccccaagggtctgctttctgctgatgtttggttcctatgtggtagggtttgctggggccatggcccacactggaagcatgctgcgactgaccttctgtgattccaacgtcattgaccattatctgtgtgacgttctccccctcttgcagctctcctgcaccagcacccatgtcagtgagctggtatttttcattgttgttggagtaatcaccatgctatccagcataagcatcgtcatctcttacgctttgatactctccaacatcctctgtattccttctgcagagggcagatccaaagcctttagcacatggggctcccacataattgctgttgctctgttttttgggtcagggacattcacctacttaacaacatcttttcctggctctatgaaccatggcagatttgcctcagtcttttacaccaatgtggttcccatgcttaacccttcgatctacagtttgaggaataaggatgataaacttgccctgggcaaaaccctgaagagagtgctcttctaatgggtctcttcatatcactggcaaccgattctcggtaa

SEQ ID NO: 161901 - DNA, 930 bp, Homo sapiens
  Payload ID: 11611
  Gene Symbol: OR1A1
  Gene Name: olfactory receptor, family 1, subfamily A, member 1
  Uniprot ID: Q9P1Q5
  ENST ID: ENST00000304094
  CDS Start-End: 1-930
atgagggaaaataaccagtcctctacactggaattcatcctcctgggagttactggtcagcaggaacaggaagatttcttctacatcctcttcttgttcatttaccccatcacattgattggaaacctgctcatcgtcctagccatttgctctgatgttcgccttcacaaccccatgtattttctccttgccaacctctccttggttgacatcttcttctcatcggtaaccatccctaagatgctggccaaccatctcttgggcagcaaatccatctcttttgggggatgcctaacgcagatgtatttcatgatagccttgggtaacacagacagctatattttggctgcaatggcatatgatcgagctgtggccatcagccgcccacttcactacacaacaattatgagtccacggtcttgtatctggcttattgctgggtcttgggtgattggaaatgccaatgccctcccccacactctgctcacagctagtctgtccttctgtggcaaccaggaagtggccaacttctactgtgacattacccccttgctgaagttatcctgttctgacatccactttcatgtgaagatgatgtacctaggggttggcattttctctgtgccattactatgcatcattgtctcctatattcgagtcttctccacagtcttccaggttccttccaccaagggcgtgctcaaggccttctccacctgtggttcccacctcacggttgtctctttgtattatggtacagtcatgggcacgtatttccgccctttgaccaattatagcctaaaagacgcagtgatcactgtaatgtacacggcagtgaccccaatgttaaatcctttcatctacagtctgagaaatcgggacatgaaggctgccctgcggaaactcttcaacaagagaatctcctcgtaa

SEQ ID NO: 161902 - DNA, 930 bp, Homo sapiens
  Payload ID: 11612
  Gene Symbol: OR1A2
  Gene Name: olfactory receptor, family 1, subfamily A, member 2
  Uniprot ID: Q9Y585
  ENST ID: ENST00000381951
  CDS Start-End: 1-930
atgaagaaagaaaatcaatcctttaacctggattttattctcctgggagttactagtcagcaagaacagaataatgtcttctttgtgatttttttgtgcatttaccccatcacactgactggaaatctgctcatcatcttggccatctgtgctgacattcgccttcacaaccccatgtattttctccttgccaacctctccttggttgacatcatcttctcatccgtaaccatccctaaggtgctggccaaccatctcttggggagcaagttcatctcctttgggggatgcctaatgcagatgtatttcatgatagccttggccaaggcagacagctataccttggctgcaatggcatacgatcgagctgtggccatcagctgcccacttcattacacaacaattatgagtccacggtcttgtatcctgcttattgctgggtcttgggtgattggaaacaccagtgctctcccccacactctgctcacagctagtttgtccttctgtggcaaccaggaagtagccaatttctactgtgacattatgcctttgctgaagttgtcctgttctgacgtccactttaatgtgaagatgatgtacctaggggtcggcgttttctctttgccattactatgcatcattgtctcctatgttcaggtcttttccacagtcttccaagttccatctaccaagagtctattcaaagccttctgcacctgtggctcccacctcacagttgtttttttatattatggtacaacgatgggcatgtatttccgccctctgaccagttacagccccaaagatgcagtgataactgtgatgtatgtggcagtgaccccagcattaaatcctttcatctatagtctgagaaattgggatatgaaggcagccctacagaaactcttcagcaagagaatctcctcatag

SEQ ID NO: 161903 - DNA, 957 bp, Homo sapiens
  Payload ID: 11613
  Gene Symbol: OR1B1
  Gene Name: olfactory receptor, family 1, subfamily B, member 1 (gene/pseudogene)
  Uniprot ID: Q8NGR6
  ENST ID: ENST00000304833
  CDS Start-End: 1-957
atgatgagctttgcccctaatgcttcacactctccggtttttttgctccttgggttctcgagagctaacatctcctacactctcctcttcttcctgttcctggctatttacctgaccaccatactggggaatgtgacactggtgctgctcatctcctgggactccagactgcactcacccatgtattatctgcttcgtggcctctctgtgatagacatggggctatccacagttacactgccccagttgctggcccatttggtctctcattacccaaccattcctgctgcccgctgcttggctcagttctttttcttctatgcatttggggttacagatacacttgtcattgctgtcatggctctggatcgctatgtggccatctgtgaccccctgcactatgctttggtaatgaatcaccaacggtgtgcctgcttactagccttgagctgggtggtgtccatactgcacaccatgttgcgtgtgggactcgtcctgcctctttgctggactggggatgctgggggcaacgttaaccttcctcacttcttttgtgaccaccggccacttctgcgagcctcttgttctgacatacattctaatgagctggccatattctttgagggtggcttccttatgctgggcccctgtgccctcattgtactctcttatgtccgaattggggccgctattctacgtttgccttcagctgctggtcgccgccgagcagtctccacctgtggatcccacctcaccatggttggtttcctctacggcaccatcatttgtgtctacttccagcctcccttccagaactctcagtatcaggacatggtggcttcagtaatgtatactgccattacacctttggccaacccatttgtgtatagcctccacaataaggatgtcaagggtgcactctgcaggctgcttgaatgggtgaaggtagacccctga

SEQ ID NO: 161904 - DNA, 945 bp, Homo sapiens
  Payload ID: 11614
  Gene Symbol: OR1C1
  Gene Name: olfactory receptor, family 1, subfamily C, member 1
  Uniprot ID: Q15619
  ENST ID: ENST00000408896
  CDS Start-End: 1-945
atggaaaaaagaaatctaacagttgtcagggaattcgtccttctgggacttcctagctcagcagagcagcagcacctcctgtctgtgctctttctctgtatgtatttagccaccaccttggggaacatgctcatcattgcgacgattggctttgactctcacctccattcccctatgtacttcttccttagtaacttggcctttgttgacatctgctttacgtcgactacagtcccccaaatggtagtgaatatcttgactggcaccaagactatctcttttgcaggctgcctcacccagctcttcttcttcgtttcttttgtgaatatggacagcctccttctgtgtgtgatggcgtatgatagatatgtggcgatttgccaccccttacattacaccgccagaatgaacctgtgcctttgtgtccagctagtggctggactgtggcttgttacttacctccacgccctcctgcatactgtcctaatagcacagctgtccttctgtgcctccaatatcatccatcatttcttctgtgatctcaatcctctcctgcagctctcttgctctgacgtctccttcaatgtaatgatcatttttgcagtaggaggtctattggctctcacgccccttgtctgtatcctcgtatcttatggacttatcttctccactgttctgaagatcacctctactcagggcaagcagagagctgtttccacctgcagctgccacctgtcagtggtggtgttgttttacggcacagccatcgccgtctatttcagcccttcatccccccatatgcctgagagcgacactctgtcaaccatcatgtattcaatggtggctccgatgctgaatcctttcatctataccctaaggaacagggatatgaagaggggacttcagaaaatgcttctcaagtgcacagtctttcagcagcaataa

SEQ ID NO: 161905 - DNA, 939 bp, Homo sapiens
  Payload ID: 11615
  Gene Symbol: OR1D2
  Gene Name: olfactory receptor, family 1, subfamily D, member 2
  Uniprot ID: P34982
  ENST ID: ENST00000331459
  CDS Start-End: 1-939
atggatggaggcaaccagagtgaaggttcagagttccttctcctggggatgtcagagagtcctgagcagcagcggatcctgttttggatgttcctgtccatgtacctggtcacggtggtgggaaatgtgctcatcatcctggccatcagctctgattcccgcctgcacacccccgtgtacttcttcctggccaacctctccttcactgacctcttctttgtcaccaacacaatccccaagatgctggtgaacctccagtcccataacaaagccatctcctatgcagggtgtctgacacagctctacttcctggtctccttggtggccctggacaacctcatcctggctgtgatggcatatgaccgctatgtggccatctgctgccccctccactacaccacagccatgagccctaagctctgtatcttactcctttccttgtgttgggtcctatccgtcctctatggcctcatacacaccctcctcatgaccagagtgaccttctgtgggtcacgaaaaatccactacatcttctgtgagatgtatgtattgctgaggatggcatgttccaacattcagattaatcacacagtgctgattgccacaggctgcttcatcttcctcattccctttggattcgtgatcatttcctatgtgctgattatcagagccatcctcagaataccctcagtctctaagaaatacaaagccttctccacctgtgcctcccatttgggtgcagtctccctcttctatgggacactttgtatggtatacctaaagcccctccatacctactctgtgaaggactcagtagccacagtgatgtatgctgtggtgacacccatgatgaatcccttcatctacagcctgaggaacaaggacatgcatggggctctgggaagactcctagataaacactttaagaggctgacatga

SEQ ID NO: 161906 - DNA, 939 bp, Homo sapiens
  Payload ID: 11616
  Gene Symbol: OR1D5
  Gene Name: olfactory receptor, family 1, subfamily D, member 5
  Uniprot ID: P58170
  ENST ID: ENST00000575751
  CDS Start-End: 1-939
atggatggagataaccagagtgagaactcacagttccttctcctggggatctcagagagtcctgagcagcagcggatcctgttttggatgttcctgtccatgtacctggtcacggtgctgggaaatgtgctcatcatcctggccatcagctctgattcccacctgcacacccccatgtacttcttcctggccaacctctccttcactgacctcttctttgtcaccaacacaatccccaagatgctggtgaacttccagtcccagaacaaagccatctcctatgcagggtgtctgacacagctctacttcctggtctccttggtgaccctggacaacctcatcctggccgtgatggcgtatgatcgctatgtggccacctgctgccccctccactatgtcacagccatgagccctgggctctgtgtcttgctcctctccttgtgttgggggctgtctgttctctatggcctcctcctcaccttcctcctgaccagggtgaccttctgtgggcctcgagagatccactacctcttctgtgacatgtacatcctgctgtggctggcatgttccaacacccacatcattcacacagcgttgattgccactggctgcttcatcttcctcacccccttagggttcatgaccacatcctatgtacgtattgtcagaaccatccttcaaatgccctcggcctctaagaaatacaaaaccttctctacctgtgcctcccatttgggtgtggtctccctcttttatgggacgcttgctatggtgtacctgcagcccctccatacctactccatgaaggactcagtagccacagtgatgtatgctgtgctgacacctatgatgaaccctttcatctacaggctgaggaacaaagacatgcatggggctccgggaagagtcctatggagaccctttcagaggcctaaatga

SEQ ID NO: 161907 - DNA, 1307 bp, Homo sapiens
  Payload ID: 11617
  Gene Symbol: OR1E1
  Gene Name: olfactory receptor, family 1, subfamily E, member 1
  Uniprot ID: P30953
  ENST ID: ENST00000322608
  CDS Start-End: 1-945
atgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctatgtatttgtttctcagcaacttgtccttctctgacctctgcttctcttccgtgaccattcccaagttgttacagaacatgcagaaccaggacccatccatcccctatgcggactgcctgacccaaatgtacttcttcctgttatttggagacctggagagcttcctccttgtggccatggcctatgaccgctatgtggccatctgcttccccctgcactacaccgccatcatgagccccatgctctgtctcgccctggtggcgctgtcctgggtgctgaccaccttccatgccatgttacacactttactcatggccaggttgtgtttttgtgcagacaatgtgatcccccactttttctgtgatatgtctgctctgctgaagctggccttctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctgtctgtggtgtcactgttctatggaaccgttattggtctctacttatgctcatcagctaatagttctactctaaaggacactgtcatggctatgatgtacactgtggtgacccccatgctgaaccccttcatctacagcctgaggaacagagacatgaagggagccctgagcagagtcattcatcagaagaaaactttcttctctctctgatgataacacttggagctattacatagtttatccagtaaaatattgatattaatattggaatattattctaaattatttcctcaccatccttttgttgaaatggcatcgtacataatttttcaatatgtagtggagatgaagcatagctgagtagttgaactagggaagagggtcttggtgacctggctaagacttcctgtttgtcttcccaaggtgatcttggaaaaatgtagtttaagaacaactgttttaaatggtcttcatgccccacattcttaaattatcacaggattttgttatgttactcagaattttgctttgattgtagaatcatttttgtttaattaaaaaaatttttaaat

SEQ ID NO: 161908 - DNA, 972 bp, Homo sapiens
  Payload ID: 11618
  Gene Symbol: OR1E2
  Gene Name: olfactory receptor, family 1, subfamily E, member 2
  Uniprot ID: P47887
  ENST ID: ENST00000248384
  CDS Start-End: 1-972
atgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctgtgtatttgtttctcagcaacttgtccttctctgacctctgcttttcctcagtcacaatgcccaaattgctgcagaacatgcagaaccaagacccatccatcccctatgcagactgcctgacccaaatgtacttcttcttgtatttttcggatctagagagcttcctccttgtggccatggcctatgaccgctatgtggccatctgcttccccatgcactacaccgccatctgcttcctcctgcactacaccgccatcatgagccccatgctctgtctctccgtggtggcgctgtcctgggtgctgaccaccttccatgccatgttacacactttactcatggccaggttgtgtttttgtgcagacaatgtgatcccccactttttctgtgatatgtctgctctgctgaagctggcctgctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctctctgtggtgtcactgttctatgggaccgttattggtctctacttatgcccatcagctaatagttctactctaaaggacactgtcatggctatgatgtacactgtggtgacccctatgctgacccccttcatctacagcctgaggaacagagacatgaagggagccctggaaagggtcatttgtaaaaggaaaaatcccttccttctatga

SEQ ID NO: 161909 - DNA, 942 bp, Homo sapiens
  Payload ID: 11619
  Gene Symbol: OR1F1
  Gene Name: olfactory receptor, family 1, subfamily F, member 1
  Uniprot ID: O43749
  ENST ID: ENST00000304646
  CDS Start-End: 1-939
atgagcgggacaaaccagtcgagtgtctccgagttcctcctcctgggactctccaggcagccccagcagcagcatctcctctttgtgttcttcctcagcatgtacctggccactgtcctggggaacctgctcatcatcctgtccgtaagcatagactcctgcctgcacacccccatgtacttcttcctcagcaacctgtcttttgtggacatctgcttctccttcaccaccgtccccaagatgctggccaatcacatactcgagactcagaccatctccttctgtggctgtctcacacagatgtatttcgttttcatgttcgtggacatggacaatttcctcctagctgtgatggcctatgaccactttgtcgccgtgtgccaccccttacattacacagcaaagatgacccatcagctctgtgccctgctggttgctggattatgggtggttgccaacctgaatgtccttctgcacaccctgctgatggctccactctcattctgtgcagacaatgccatcactcacttcttctgcgatgtgactcccctactgaaactctcctgctcagacacacacctcaatgaggtcataatccttagtgagggtgccctggtcatgatcaccccatttctttgcatcctggcttcttatatgcacatcacctgcactgtcctgaaggtcccatccacaaagggaaggtggaaagccttctccacctgtggttctcacctggctgtggttctcctcttctacagcaccatcattgctgtgtattttaaccctctgtcctcccactcagctgagaaagacactatggctactgtgttgtatacagtagtgactcccatgctaaaccctttcatctacagcctgaggaacaggtacttgaaaggggctctgaaaaaagtagttggcagggtggtgttttctgtctgatga

SEQ ID NO: 161910 - DNA, 998 bp, Homo sapiens
  Payload ID: 11620
  Gene Symbol: OR1G1
  Gene Name: olfactory receptor, family 1, subfamily G, member 1
  Uniprot ID: P47890
  ENST ID: ENST00000328890
  CDS Start-End: 31-972
caattaacccaactttcttcctacagacaaatggaggggaaaaatctgaccagcatctcagaatgtttcctcctggggttctctgagcagctggaggagcagaagcccctctttgggtccttcctgttcatgtacttggtcacggtggcaggcaacctcctcatcattctagtcatcattactgacactcaactccatacccccatgtacttctttctagccaacctctcccttgcagatgcctgctttgtgtccaccacagtccctaagatgctggcaaacatacagatccagagtcaggccatctcctactcagggtgtctactacagttgtattttttcatgttatttgtgatgctggaggcattcctcttggcggtcatggcctatgactgctacgtggccatatgccacccacttcattacattctgatcatgagccctgggctctgcatcttcctcgtgtctgcatcctggatcatgaatgccctccactcccttctacacacacttctgatgaacagcctgtccttctgcgcaaaccatgagatcccacacttcttctgtgacatcaatcccctcctgagtctgtcctgcacagaccccttcaccaatgagctggtgatcttcatcactgggggtctcacaggactcatttgtgtgctttgcctgattatctcttacacgaacgttttctcgaccatcctgaagatcccatcagctcaggggaagcggaaagccttttccacctgcagctctcatctctccgtggtctctctcttctttgggacttctttttgtgttgatttcagttctccctcaacccactcggcccagaaggacacagttgcatcagtgatgtacacagtggtaactccaatgttgaatccctttatctacagtttgaggaaccaagaaataaagtcttccctgagaaagttaatctgggttcggaaaattcattccccttagtggtagtgacttgacatccaatatgg

SEQ ID NO: 161911 - DNA, 1242 bp, Homo sapiens
  Payload ID: 11621
  Gene Symbol: OR1I1
  Gene Name: olfactory receptor, family 1, subfamily I, member 1
  Uniprot ID: O60431
  ENST ID: ENST00000209540
  CDS Start-End: 87-1154
gggaagctgggaccagaatggcatctctgacacctggctctgtgtggtttttctccctttttgttcccactagtcacagaccatacatggaaccagaaaagcaaaccgaaatctcagaattcttcctccagggactctcagaaaagccagagcatcagaccctcctcttcacaatgttcctctccacatacctggtcaccatcattggaaatgccctcattatcctggccatcatcacggactctcacctccacacacccatgtacttctttctcttcaacctctcactcgttgacaccctattatcctccaccaccgtccccaagatgctagcgaacatccaggctcagagcagagccatcccctttgtgggctgcctcacccagatgtatgccttccacctgttcgggaccatggacagctttctcctggcagtaatggccatcgaccgcttcgtggccattgtccacccacagcgttacttggttctcatgtgctcccctgtctgtgggctgctgctgggagcatcatggatgatcaccaacctccagtctctcatacacacctgcctcatggctcaactgaccttctgcgccggctctgaaatctcccacttcttctgtgacctcatgcccctgctgaagctctccggctcagacacgcacaccaacgagctggtgatctttgcttttggcattgtcgtgggcaccagcccattctcctgcatccttctctcgtacatccgcattttctggacagtctttaagatcccttctactcggggcaagtggaaagccttctccacctgtggcttacacctcactgtggtgtcactgtcctatgggaccatctttgctgtgtacttacagcccacatcccccagctcctcccagaaggacaaggcagccgccctaatgtgtggggtgttcatccccatgctcaacccctttatctacagcatacggaacaaggatatgaaggcagccctggggaagctcatcggcaaagtggccgtcccctgtcctaggccagaacagttattggatgtttatcatgttccaggatcactgttggctgctagggacacagagatgcatcccatcccctaccctggaggagttcagagtctagctgggaacagagacatggaataaatccttccagtacaacgtgataaatgtgtcataaagagatgaacaaagtgtatgagcacccaaaggaaaggtgtgcattttccccagg

SEQ ID NO: 161912 - DNA, 969 bp, Homo sapiens
  Payload ID: 11622
  Gene Symbol: OR1J1
  Gene Name: olfactory receptor, family 1, subfamily J, member 1
  Uniprot ID: Q8NGS3
  ENST ID: ENST00000259357
  CDS Start-End: 1-969
atgagccctgagaaccagagcagcgtgtccgagttcctcctcctgggcctccccatccggccagagcagcaggccgtgttcttcgccctgttcctgggcatgtacctgaccacggtgctggggaacctgctcatcatgctgctcatccagctagactctcaccttcacacccccatgtacttcttccttagccacttggccctcactgacatctccttttcatctgtcactgtccctaagatgctgatgaacatgcagactcagcacctagccgtcttttacaagggatgcatttcacagacatattttttcatattttttgctgacttagacagtttccttatcacttcaatggcatatgacaggtatgtggccatctgtcatcctctacattatgccaccatcatgactcagagccagtgtgtcatgctggtggctgggtcctgggtcatcgcttgtgcgtgtgctcttttgcataccctcctcctggcccagctttccttctgtgctgaccacatcatccctcactacttctgtgaccttggtgccctgctcaagttgtcctgctcagacacctccctcaatcagttagcaatctttacagcagcattgacagccattatgcttccattcctgtgcatcctggtttcttatggtcacattggggtcaccatcctccagattccctctaccaagggcatatgcaaagccttgtccacttgtggatcccacctctcagtggtgactatctattatcggacaattattggtctctattttcttcccccatccagcaacaccaatgacaagaacataattgcttcagtgatatacacagcagtcactcccatgttgaacccattcatttacagtctgagaaataaagacattaagggagccctaagaaaactcttgagtaggtcaggcgcagtggctcatgcctgtaatctcaacactttgggaggctga

SEQ ID NO: 161913 - DNA, 942 bp, Homo sapiens
  Payload ID: 11623
  Gene Symbol: OR1J2
  Gene Name: olfactory receptor, family 1, subfamily J, member 2
  Uniprot ID: Q8NGS2
  ENST ID: ENST00000335302
  CDS Start-End: 1-942
atgagccctgagaaccagagcagcgtgtccgagttcctccttctgggcctccccatccggccagagcagcaggctgtgttcttcaccctgttcctgggcatgtacctgaccacggtgctggggaacctgctcatcatgctgctcatccagctggactctcaccttcacacccccatgtacttcttcctcagccacttggctctcactgacatctccttttcatctgtcactgtccctaagatgctgatggacatgcggactaagtacaaatcgatcctctatgaggaatgcatttctcagatgtatttttttatattttttactgacctggacagcttccttattacatcaatggcatatgaccgatatgttgccatatgtcaccctctccactacactgtcatcatgagggaagagctctgtgtcttcttagtggctgtatcttggattctgtcttgtgccagctccctctctcacacccttctcctgacccggctgtctttctgtgctgcgaacaccatcccccatgtcttctgtgaccttgctgccctgctcaagctgtcctgctcagatatcttcctcaatgagctggtcatgttcacagtaggggtggtggtcattaccctgccattcatgtgtatcctggtatcatatggctacattggggccaccatcctgagggtcccttcaaccaaagggatccacaaagcattgtccacatgtggctcccatctctctgtggtgtctctctattatgggtcaatatttggccagtaccttttcccgactgtaagcagttctattgacaaggatgtcattgtggctctcatgtacacggtggtcacacccatgttgaacccctttatctacagccttaggaacagggacatgaaagaggcccttgggaaactcttcagtagagcaacatttttctcttggtga

SEQ ID NO: 161914 - DNA, 942 bp, Homo sapiens
  Payload ID: 11624
  Gene Symbol: OR1J4
  Gene Name: olfactory receptor, family 1, subfamily J, member 4
  Uniprot ID: Q8NGS1
  ENST ID: ENST00000340750
  CDS Start-End: 1-942
atgaagagggagaatcagagcagtgtgtctgagttcctcctcctggacctccccatctggccagagcagcaggctgtgttcttcaccctgttcttgggcatgtacctgatcacggtgctggggaacctgctcatcatcctgctcatccggctggactctcaccttcacacccccatgttcttcttcctcagccacttggctctcactgacatctccctttcatctgtcactgtcccaaagatgttattaagcatgcaaactcaggatcaatccattctttatgcagggtgtgtaactcagatgtattttttcatatttttcactgatctagacaatttccttctcacttcaatggcatacgatcggtatgtggccatctgtcaccccctccgctacaccactatcatgaaagagggactgtgtaacttactagtcactgtgtcctggatcctctcctgtaccaatgccctgtctcacactctcctcctggcccagctgtccttttgtgctgacaacaccatcccccatttcttctgtgatcttgttgccctactcaagctctcatgctcagacatctccctcaatgagctggtcattttcacagtgggacaggcagtcattactctaccactaatatgcatcttgatctcttatggccacattggggtcaccatcctcaaggctccatctactaagggcatcttcaaagctttgtccacctgtggctctcacctctctgtggtgtctctgtattatggcacaattattggactgtattttctcccctcatccagtgcctccagtgacaaggacgtaattgcctctgtgatgtacacggtgatcaccccattgctgaatcccttcatttatagcctaaggaacagggacataaagggagccctggagagactcttcaacagggcaacagtcttatctcaatga

SEQ ID NO: 161915 - DNA, 951 bp, Homo sapiens
  Payload ID: 11625
  Gene Symbol: OR1K1
  Gene Name: olfactory receptor, family 1, subfamily K, member 1
  Uniprot ID: Q8NGR3
  ENST ID: ENST00000277309
  CDS Start-End: 1-951
atggaggctgccaatgagtcttcagagggaatctcattcgttttattgggactgacaacaagtcctggacagcagcggcctctctttgtgctgttcttgctcttgtatgtggccagcctcctgggtaatggactcattgtggctgccatccaggccagtccagcccttcatgcacccatgtacttcctgctggcccacctgtcctttgctgacctctgcttcgcctccgtcactgtgcccaagatgttggccaacttgttggcccatgaccactccatctcgctggctggctgcctgacccaaatgtacttcttctttgccctgggggtaactgatagctgtcttctggcggccatggcctatgactgctacgtggccatccggcaccccctcccctatgccacgaggatgtcccgggccatgtgcgcagccctggtgggaatggcatggctggtgtcccacgtccactccctcctgtatatcctgctcatggctcgcttgtccttctgtgcttcccaccaagtgccccacttcttctgtgaccaccagcctctcttaaggctctcgtgctctgacacccaccacatccagctgctcatcttcaccgagggcgccgcagtggtggtcactcccttcctgctcatcctcgcctcctatggggccatcgcagctgccgtgctccagctgccctcagcctctgggaggctccgggctgtgtccacctgtggctcccacctggctgtggtgagcctcttctatgggacagtcattgcagtctacttccaggccacatcccgacgcgaggcagagtggggccgtgtggccactgtcatgtacactgtagtcacccccatgctgaaccccatcatctacagcctctggaatcgcgatgtacagggggcactccgagcccttctcattgggcgaaggatctcagctagtgactcctga

SEQ ID NO: 161916 - DNA, 933 bp, Homo sapiens
  Payload ID: 11626
  Gene Symbol: OR1L1
  Gene Name: olfactory receptor, family 1, subfamily L, member 1
  ENST ID: ENST00000309623
  CDS Start-End: 1-933
atgggaagaaataacctaacaagaccctctgaattcatcctccttggactctcctctcgacctgaggatcagaagccgctctttgctgtgttcctccccatctaccttatcacagtgataggaaacctgcttatcatcctggccatccgctcagacactcgtctccagacgcccatgtacttctttctaagcatcctgtcttttgttgacatttgctatgtgacagtcattatccctaagatgctggtgaacttcttatcagagacaaagaccatctcttacagtgagtgtctgacccagatgtactttttcttagcctttggaaacacagacagttacctgctagcagccatggccattgaccgctatgtggccatatgtaatcccttccactacatcaccattatgagtcacagatgctgtgtcctgcttctggttctctccttctgcattccacattttcactccctcctgcacattcttctgactaatcagctcatcttctgtgcctcaaatgtcatccatcactttttctgcgatgatcaaccagtgctaaaattgtcctgttcctcccattttgtcaaagaaatcacagtaatgacagaaggcttggctgtcataatgaccccgttttcatgcatcatcatctcttatttaagaatcctcatcactgttctgaagattccttcagctgctggaaagcgtaaagcattttctacctgtggctctcatctcacagtggtgaccctgttttatggaagcattagctatctctattttcagcccctgtccaactatactgtcaaggatcaaatagcaacaattatctacaccgtactgactcctatgctaaatccatttatctatagtctgaggaacaaagacatgaagcagggtttggcaaagttgatgcacaggatgaaatgtcagtaa

SEQ ID NO: 161917 - DNA, 1083 bp, Homo sapiens
  Payload ID: 11626
  Gene Symbol: OR1L1
  Gene Name: olfactory receptor, family 1, subfamily L, member 1
  Uniprot ID: Q8NH94
  ENST ID: ENST00000373686
  CDS Start-End: 1-1083
atggaaagaaaccacaatccagataattgtaatgttttaaattttttctttgctgataagaagaataaaaggagaaattttggacagattgtatcagatgttggaagaatctgttacagtgttagtttatctttaggtgaacccacaactatgggaagaaataacctaacaagaccctctgaattcatcctccttggactctcctctcgacctgaggatcagaagccgctctttgctgtgttcctccccatctaccttatcacagtgataggaaacctgcttatcatcctggccatccgctcagacactcgtctccagacgcccatgtacttctttctaagcatcctgtcttttgttgacatttgctatgtgacagtcattatccctaagatgctggtgaacttcttatcagagacaaagaccatctcttacagtgagtgtctgacccagatgtactttttcttagcctttggaaacacagacagttacctgctagcagccatggccattgaccgctatgtggccatatgtaatcccttccactacatcaccattatgagtcacagatgctgtgtcctgcttctggttctctccttctgcattccacattttcactccctcctgcacattcttctgactaatcagctcatcttctgtgcctcaaatgtcatccatcactttttctgcgatgatcaaccagtgctaaaattgtcctgttcctcccattttgtcaaagaaatcacagtaatgacagaaggcttggctgtcataatgaccccgttttcatgcatcatcatctcttatttaagaatcctcatcactgttctgaagattccttcagctgctggaaagcgtaaagcattttctacctgtggctctcatctcacagtggtgaccctgttttatggaagcattagctatctctattttcagcccctgtccaactatactgtcaaggatcaaatagcaacaattatctacaccgtactgactcctatgctaaatccatttatctatagtctgaggaacaaagacatgaagcagggtttggcaaagttgatgcacaggatgaaatgtcagtaa

SEQ ID NO: 161918 - DNA, 975 bp, Homo sapiens
  Payload ID: 11627
  Gene Symbol: OR1L3
  Gene Name: olfactory receptor, family 1, subfamily L, member 3
  Uniprot ID: Q8NH93
  ENST ID: ENST00000304820
  CDS Start-End: 1-975
atgggaatgtccaacctgacaagactctctgaatttattctcttgggactctcctctcggtctgaagaccagaggccactctttgccctctttcttatcatatacctggtcactttgatgggaaatctgctcatcatcttggctatccactctgatcctcgacttcaaaaccctatgtattttttcctaagcatcttgtcctttgctgatatttgctacacaacagtcatagtcccaaagatgctcgtgaacttcttatcagagaaaaagaccatttcctatgctgaatgtctggcacagatgtatttcttcctggtttttggaaacatagatagttatctcctggcggctatggccatcaaccgctgtgtagccatttgtaacccattccattatgtcactgttatgaaccgcagatgctgtgtgttgctactagcattccccatcactttctcctatttccactctctcctacatgtcctcctggtgaatcggctcaccttttgtacatcaaatgttatccatcattttttttgtgatgtcaaccctgtgctgaaactgtcctgctcctccacctttgtcaatgaaattgtggccatgacagaagggctggcctctgtgatggctccatttgtctgtatcatcatctcttatctaagaattctcatcgctgttctcaagattccctcagcagctggaaaacacaaagccttctccacctgcagctcccatctcactgtggtgattctgttttatgggagtattagctatgtctatttgcagcctttgtccagctatactgtcaaggaccgaatagcaacaatcaactacactgtgttgacatcagtgttgaacccatttatctacagtttaagaaacaaagacatgaaacggggcttacagaaattgataaacaagattaagtctcaaatgagtaggttctctacaaagaccaataaaatctgtggaccctga

SEQ ID NO: 161919 - DNA, 936 bp, Homo sapiens
  Payload ID: 11628
  Gene Symbol: OR1L4
  Gene Name: olfactory receptor, family 1, subfamily L, member 4
  Uniprot ID: Q8NGR5
  ENST ID: ENST00000259466
  CDS Start-End: 1-936
atggagacaaagaattatagcagcagcacctcaggcttcatcctcctgggcctctcttccaaccctaagctgcagaaacctctctttgccatcttcctcatcatgtacctactcactgcggtggggaatgtgctcatcatcctggccatctactctgaccccaggctccacacccctatgtacttttttctcagcaacttgtctttcatggatatctgcttcacaacagtcatagtgcctaagatgctggtgaattttctatcagagacaaagattatctcttatgtgggctgcctgatccagatgtacttcttcatggcatttgggaacactgacagctacctgctggcctctatggccatcgaccggctggtggccatctgcaaccccttacactatgatgtggttatgaaaccatggcattgcctactcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtaccatcttctcctacctgcaaatcatcgtcactgtgctcagaatcccctctgcagccgggaagtggaaggccttctctacctgtggctcccacctcactgtagtggtcctgttctatgggagtgtcatctatgtctattttaggcctctgtccatgtactcagtgatgaagggccgggtagccacagttatgtacacagtagtgacacccatgctgaaccctttcatctacagcctgaggaacaaagatatgaaaaggggtttgaagaaattaagacacagaatttactcatag

SEQ ID NO: 161920 - DNA, 936 bp, Homo sapiens
  Payload ID: 11629
  Gene Symbol: OR1L6
  Gene Name: olfactory receptor, family 1, subfamily L, member 6
  ENST ID: ENST00000304720
  CDS Start-End: 1-936
atggagataaagaactacagcagcagcacctcaggcttcatcctcctgggcctctcttccaaccctcagctgcagaaacctctctttgccatcttcctcatcatgtacctgctcgctgcggtggggaatgtgctcatcatcccggccatctactctgaccccaggctccacacccctatgtacttttttctcagcaacttgtctttcatggatatctgcttcacaacagtcatagtgcctaagatgctggtgaattttctatcagagacaaaggttatctcctatgtgggctgcctggcccagatgtacttctttatggcatttgggaacactgacagctacctgctggcctctatggccatcgaccggctggtggccatctgcaaccccttacactatgatgtggttatgaaaccacggcattgcctgctcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtatcatcttctcctacctgcgaatcatggtcactgtgctcagaatcccctctgcagccgggaagtggaaggccttctctacctgtggctcccacctcactgcagtagcccttttctatgggagtattatttatgtctattttaggcccctgtccatgtactcagtggttagggaccgggtagccacagttatgtacacagtagtgacacccatgctgaaccctttcatctacagcctgaggaacaaagatatgaagaggggtttgaagaaattacaggacagaatttaccggtaa

SEQ ID NO: 161921 - DNA, 1044 bp, Homo sapiens
  Payload ID: 11629
  Gene Symbol: OR1L6
  Gene Name: olfactory receptor, family 1, subfamily L, member 6
  Uniprot ID: Q8NGR2
  ENST ID: ENST00000373684
  CDS Start-End: 1-1044
atgagctatttttacaggcttaagcttatgaaagaagctgtcttggtcaaactgccctttacatctctcccactgcttctccaaaccctatccaggaagtccagagacatggagataaagaactacagcagcagcacctcaggcttcatcctcctgggcctctcttccaaccctcagctgcagaaacctctctttgccatcttcctcatcatgtacctgctcgctgcggtggggaatgtgctcatcatcccggccatctactctgaccccaggctccacacccctatgtacttttttctcagcaacttgtctttcatggatatctgcttcacaacagtcatagtgcctaagatgctggtgaattttctatcagagacaaaggttatctcctatgtgggctgcctggcccagatgtacttctttatggcatttgggaacactgacagctacctgctggcctctatggccatcgaccggctggtggccatctgcaaccccttacactatgatgtggttatgaaaccacggcattgcctgctcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtatcatcttctcctacctgcgaatcatggtcactgtgctcagaatcccctctgcagccgggaagtggaaggccttctctacctgtggctcccacctcactgcagtagcccttttctatgggagtattatttatgtctattttaggcccctgtccatgtactcagtggttagggaccgggtagccacagttatgtacacagtagtgacacccatgctgaaccctttcatctacagcctgaggaacaaagatatgaagaggggtttgaagaaattacaggacagaatttaccggtaa

SEQ ID NO: 161922 - DNA, 930 bp, Homo sapiens
  Payload ID: 11630
  Gene Symbol: OR1L8
  Gene Name: olfactory receptor, family 1, subfamily L, member 8
  Uniprot ID: Q8NGR8
  ENST ID: ENST00000304865
  CDS Start-End: 1-930
atggaaagaatcaaccacaccagcagtgtctccgagtttatcctcctgggactctcctcccggcctgaggaccaaaagacactctttgttctcttcctcatcgtgtacctggtcaccataacagggaacctgctcatcatcctggccattcgcttcaacccccatcttcagacccctatgtatttcttcttgagttttctgtctctcactgatatttgctttacaacaagcgttgtccccaagatgctgatgaacttcctgtcagaaaagaagaccatctcctatgctgggtgtctgacacagatgtattttctctatgccttgggcaacagtgacagctgccttctggcagtcatggcctttgaccgctatgtggccgtctgtgaccctttccactatgtcaccaccatgagccaccaccactgtgtcctgctggtggccttctcctgctcatttcctcacctccactcactcctgcacacacttctgctgaatcgtctcaccttctgtgactccaatgttatccaccactttctctgtgacctcagccctgtgctgaaattgtcctgctcttccatatttgtcaatgaaattgtgcagatgacagaagcacctattgttttggtgactcgttttctctgcattgctttctcttatatacgaatcctcactacagttctcaagattccctctacttctgggaaacgcaaagccttctccacctgtggtttttacctcaccgtggtgacgctcttttatggaagcatcttctgtgtctatttacagcccccatccacctacgctgtcaaggaccacgtggcaacaattgtttacacagttttgtcatccatgctcaatccttttatctacagcctgagaaacaaagacctgaaacagggcctgaggaagcttatgagcaagagatcctag

SEQ ID NO: 161923 - DNA, 1035 bp, Homo sapiens
  Payload ID: 11631
  Gene Symbol: OR1M1
  Gene Name: olfactory receptor, family 1, subfamily M, member 1
  Uniprot ID: Q8NGA1
  ENST ID: ENST00000429566
  CDS Start-End: 67-1008
ttccaaaaccatctccctgtcattcctataacctcccctttccatacttccagaggaatcacacccatggaaccaagaaaccaaaccagtgcatctcaattcatcctcctgggactctcagaaaagccagagcaggagacgcttctcttttccctgttcttctgcatgtacctggtcatggtcgtggggaacctgctcatcatcctggccatcagcatagactcccacctccacacccccatgtacttcttcctggccaacctgtccctggttgatttctgtctggccaccaacaccatccctaagatgctggtgagccttcaaaccgggagcaaggccatctcttatccctgctgcctgatccagatgtacttcttccatttctttggcatcgtggacagcgtcataatcgccatgatggcttatgaccggttcgtggccatctgccacccattgcactacgccaagatcatgagcctacgcctctgtcgcctgctggtcggcgccctctgggcgttttcctgcttcatctcactcactcacatcctcctgatggcccgtctcgttttctgcggcagccatgaggtgcctcactacttctgcgacctcactcccatcctccgactttcgtgcacggacacctctgtgaataggatcttcatcctcattgtggcagggatggtgatagccacgccctttgtctgcatcctggcctcctatgctcgcatccttgtggccatcatgaaggtcccctctgcaggcggcaggaagaaagccttctccacctgcagctcccacctgtctgtggttgctctcttctatgggaccaccattggcgtctatctgtgtccctcctcggtcctcaccactgtgaaggagaaagcttctgcggtgatgtacacagcagtcacccccatgctgaatcccttcatctacagcttgaggaacagagacctgaaaggggctctcaggaagctggtcaacagaaagatcacctcatcttcctgaccaccaggactcaggaacttctggggg

SEQ ID NO: 161924 - DNA, 936 bp, Homo sapiens
  Payload ID: 11632
  Gene Symbol: OR1N1
  Gene Name: olfactory receptor, family 1, subfamily N, member 1
  Uniprot ID: Q8NGS0
  ENST ID: ENST00000304880
  CDS Start-End: 1-936
atggaaaaccaatccagcatttctgaatttttcctccgaggaatatcagcgcctccagagcaacagcagtccctcttcggaattttcctgtgtatgtatcttgtcaccttgactgggaacctgctcatcatcctggccattggctctgacctgcacctccacacccccatgtactttttcttggccaacctgtcttttgttgacatgggtttaacgtcctccacagttaccaagatgctggtgaatatacagactcggcatcacaccatctcctatacgggttgcctcacgcaaatgtatttctttctgatgtttggtgatctagacagcttcttcctggctgccatggcgtatgaccgctatgtggccatttgccaccccctctgctactccacagtcatgaggccccaagtctgtgccctaatgcttgcattgtgctgggtcctcaccaatatcgttgccctgactcacacgttcctcatggctcggttgtccttctgtgtgactggggaaattgctcactttttctgtgacatcactcctgtcctgaagctgtcatgttctgacacccacatcaacgagatgatggtttttgtcttgggaggcaccgtactcatcgtcccctttttatgcattgtcacctcctacatccacattgtgccagctatcctgagggtccgaacccgtggtggggtgggcaaggccttttccacctgcagttcccacctctgcgttgtttgtgtgttctatgggaccctcttcagtgcctacctgtgtcctccctccattgcctctgaagagaaggacattgcagcagctgcaatgtacaccatagtgactcccatgttgaacccctttatctatagcctaaggaacaaggacatgaagggggccctaaagaggctcttcagtcacaggagtattgtttcctcttag

SEQ ID NO: 161925 - DNA, 939 bp, Homo sapiens
  Payload ID: 11632
  Gene Symbol: OR1N1
  Gene Name: olfactory receptor, family 1, subfamily N, member 1
  ENST ID: ENST00000619659
  CDS Start-End: 1-939
gtcatggaaaaccaatccagcatttctgaatttttcctccgaggaatatcagcgcctccagagcaacagcagtccctcttcggaattttcctgtgtatgtatcttgtcaccttgactgggaacctgctcatcatcctggccattggctctgacctgcacctccacacccccatgtactttttcttggccaacctgtcttttgttgacatgggtttaacgtcctccacagttaccaagatgctggtgaatatacagactcggcatcacaccatctcctatacgggttgcctcacgcaaatgtatttctttctgatgtttggtgatctagacagcttcttcctggctgccatggcgtatgaccgctatgtggccatttgccaccccctctgctactccacagtcatgaggccccaagtctgtgccctaatgcttgcattgtgctgggtcctcaccaatatcgttgccctgactcacacgttcctcatggctcggttgtccttctgtgtgactggggaaattgctcactttttctgtgacatcactcctgtcctgaagctgtcatgttctgacacccacatcaacgagatgatggtttttgtcttgggaggcaccgtactcatcgtcccctttttatgcattgtcacctcctacatccacattgtgccagctatcctgagggtccgaacccgtggtggggtgggcaaggccttttccacctgcagttcccacctctgcgttgtttgtgtgttctatgggaccctcttcagtgcctacctgtgtcctccctccattgcctctgaagagaaggacattgcagcagctgcaatgtacaccatagtgactcccatgttgaacccctttatctatagcctaaggaacaaggacatgaagggggccctaaagaggctcttcagtcacaggagtattgtttcctcttag

SEQ ID NO: 161926 - DNA, 1103 bp, Homo sapiens
  Payload ID: 11633
  Gene Symbol: OR1N2
  Gene Name: olfactory receptor, family 1, subfamily N, member 2
  Uniprot ID: Q8NGR9
  ENST ID: ENST00000373688
  CDS Start-End: 59-1051
cagttctggccacacagatgcatatctgtaaattgatctaataaataaatactgacacatggaaggtttttatctgcgcagatcacacgaactacaagggatgggaaaaccaggcagagtgaaccaaaccactgtttcagacttcctccttctaggactctctgagtggccagaggagcagcctcttctgtttggcatcttccttggcatgtacctggtcaccatggtggggaacctgctcattatcctggccatcagctctgacccacacctccatactcccatgtacttctttctggccaacctgtcattaactgatgcctgtttcacttctgcctccatccccaaaatgctggccaacattcatacccagagtcagatcatctcgtattctgggtgtcttgcacagctatatttcctccttatgtttggtggccttgacaactgcctgctggctgtgatggcatatgaccgctatgtggccatctgccaaccactccattacagcacatctatgagtccccagctctgtgcactaatgctgggtgtgtgctgggtgctaaccaactgtcctgccctgatgcacacactgttgctgacccgcgtggctttctgtgcccagaaagccatccctcatttctattgtgatcctagtgctctcctgaagcttgcctgctcagatacccatgtaaacgagctgatgatcatcaccatgggcttgctgttcctcactgttcccctcctgctgatcgtcttctcctatgtccgcattttctgggctgtgtttgtcatctcatctcctggagggagatggaaggccttctctacctgtggttctcatctcacggtggttctgctcttctatgggtctcttatgggtgtgtatttacttcctccatcaacttactctacagagagggaaagtagggctgctgttctctatatggtgattattcccacgctaaacccattcatttatagcttgaggaacagagacatgaaggaggctttgggtaaactttttgtcagtggaaaaacattctttttatgattagacatctagacggtgatgtctaatcttgatcaacccctccctgtcttcc

SEQ ID NO: 161927 - DNA, 924 bp, Homo sapiens
  Payload ID: 11633
  Gene Symbol: OR1N2
  Gene Name: olfactory receptor, family 1, subfamily N, member 2
  ENST ID: ENST00000616791
  CDS Start-End: 1-924
ggcagagtgaaccaaaccactgtttcagacttcctccttctaggactctctgagtggccagaggagcagcctcttctgtttggcatcttccttggcatgtacctggtcaccatggtggggaacctgctcattatcctggccatcagctctgacccacacctccatactcccatgtacttctttctggccaacctgtcattaactgatgcctgtttcacttctgcctccatccccaaaatgctggccaacattcatacccagagtcagatcatctcgtattctgggtgtcttgcacagctatatttcctccttatgtttggtggccttgacaactgcctgctggctgtgatggcatatgaccgctatgtggccatctgccaaccactccattacagcacatctatgagtccccagctctgtgcactaatgctgggtgtgtgctgggtgctaaccaactgtcctgccctgatgcacacactgttgctgacccgcgtggctttctgtgcccagaaagccatccctcatttctattgtgatcctagtgctctcctgaagcttgcctgctcagatacccatgtaaacgagctgatgatcatcaccatgggcttgctgttcctcactgttcccctcctgctgatcgtcttctcctatgtccgcattttctgggctgtgtttgtcatctcatctcctggagggagatggaaggccttctctacctgtggttctcatctcacggtggttctgctcttctatgggtctcttatgggtgtgtatttacttcctccatcaacttactctacagagagggaaagtagggctgctgttctctatatggtgattattcccacgctaaacccattcatttatagcttgaggaacagagacatgaaggaggctttgggtaaactttttagaaaaagaagc

SEQ ID NO: 161928 - DNA, 945 bp, Homo sapiens
  Payload ID: 11634
  Gene Symbol: OR1Q1
  Gene Name: olfactory receptor, family 1, subfamily Q, member 1
  Uniprot ID: Q15612
  ENST ID: ENST00000297913
  CDS Start-End: 1-945
atggacaacagcaactggaccagtgtgtcccattttgttctcttgggcatttccacccacccagaagagcaaatcccactcttccttgttttctcactcatgtacgcaatcaatatttctggcaacttggccatcatcacactgattctctctgctccacgcctccacatccccatgtacatcttcctcagtaacttggccttgacagacatctgcttcacctccaccacggtccccaagatgctgcagattattttctcccctacaaaggtaatttcctacacaggctgtttagcccaaacttatttcttcatttgcttcgccgtcatggaaaacttcatcctggctgtgatggcctatgacaggtacattgccatctgccaccctttccactacactatgatcctgactagaatgctgtgtgtgaagatggtggtcatgtgccatgctctctcccaccttcatgccatgctgcatacctttctcataggccaactaatcttctgtgcagataacagaatcccccacttcttctgtgacctctacgctctgatgaagatctcctgcaccagcacctacctcaacacccttatgattcacacagaaggtgctgttgtaatcagtggagctctggccttcattactgcctcctatgcctgcatcatcctggtggtcctccggatcccctcagccaagggcaggtggaaaaccttttctacctgcggctcccacctcactgtggtggccatattctatggcaccctcagttgggtctacttccggcccctttccagctattcagtgaccaagggtcgcattataacagtcgtgtacacagtggtgactcccatgctgaaccccttcatctacagcctgaggaatggggatgtcaagggaggcttcatgaaatggatgagcagaatgcagacttttttctttagataa

SEQ ID NO: 161929 - DNA, 978 bp, Homo sapiens
  Payload ID: 11635
  Gene Symbol: OR1S1
  Gene Name: olfactory receptor, family 1, subfamily S, member 1 (gene/pseudogene)
  Uniprot ID: Q8NH92
  ENST ID: ENST00000309433
  CDS Start-End: 1-978
atgaagacttttagttcctttcttcagatcggcagaaatatgcatcaaggaaaccaaaccaccatcactgaattcattctcctgggatttttcaagcaggatgagcatcaaaacctcctctttgtgcttttcttgggtatgtacctggtcactgtgattgggaacgggctcatcattgtggctatcagcttggatacgtaccttcatacccccatgtatctcttccttgccaatctatcctttgctgatatttcctccatttccaactcagtccccaaaatgctggtgaatattcaaaccaagagtcaatccatctcttatgagagctgcatcacacagatgtacttttctattgtgtttgtcgtcattgacaatttgctcttggggaccatggcctatgaccactttgtggcgatctgccaccctctgaattatacaattctcatgcggcccaggttcggcattttgctcacagtcatctcatggttcctcagtaatattattgctctgacacacacccttctgctcattcaattgctcttctgtaaccacaacactctcccacacttcttctgtgacttggcccctctgctcaaactgtcctgttcagatacattgatcaatgagcttgtgttgtttattgtgggtttatcagttatcatcttcccctttacactcagcttcttttcctatgtctgcatcatcagagctgtcctgagagtatcttccacacagggaaagtggaaagccttctccacttgtggctctcacctgacagttgtattactgttctacggaaccattgtaggcgtgtactttttcccctcctccactcaccctgaggacactgataagattggtgctgtcctattcactgtggtgacacccatgataaaccccttcatctacagcttgaggaataaggatatgaaaggtgccctgagaaagctcatcaatagaaaaatttcttccctttga

SEQ ID NO: 161930 - DNA, 979 bp, Homo sapiens
  Payload ID: 11635
  Gene Symbol: OR1S1
  Gene Name: olfactory receptor, family 1, subfamily S, member 1 (gene/pseudogene)
  Uniprot ID: Q8NH92
  ENST ID: ENST00000624470
  CDS Start-End: 1-978
atgaagacttttagttcctttcttcagatcggcagaaatatgcatcaaggaaaccaaaccaccatcactgaattcattctcctgggatttttcaagcaggatgagcatcaaaacctcctctttgtgcttttcttgggtatgtacctggtcactgtgattgggaacgggctcatcattgtggctatcagcttggatacgtaccttcatacccccatgtatctcttccttgccaatctatcctttgctgatatttcctccatttccaactcagtccccaaaatgctggtgaatattcaaaccaagagtcaatccatctcttatgagagctgcatcacacagatgtacttttctattgtgtttgtcgtcattgacaatttgctcttggggaccatggcctatgaccactttgtggcgatctgccaccctctgaattatacaattctcatgcggcccaggttcggcattttgctcacagtcatctcatggttcctcagtaatattattgctctgacacacacccttctgctcattcaattgctcttctgtaaccacaacactctcccacacttcttctgtgacttggcccctctgctcaaactgtcctgttcagatacattgatcaatgagcttgtgttgtttattgtgggtttatcagttatcatcttcccctttacactcagcttcttttcctatgtctgcatcatcagagctgtcctgagagtatcttccacacagggaaagtggaaagccttctccacttgtggctctcacctgacagttgtattactgttctacggaaccattgtaggcgtgtactttttcccctcctccactcaccctgaggacactgataagattggtgctgtcctattcactgtggtgacacccatgataaaccccttcatctacagcttgaggaataaggatatgaaaggtgccctgagaaagctcatcaatagaaaaatttcttccctttgat

SEQ ID NO: 161931 - DNA, 978 bp, Homo sapiens; identical to SEQ ID NO: 161929
  Payload ID: 11635
  Gene Symbol: OR1S1
  Gene Name: olfactory receptor, family 1, subfamily S, member 1 (gene/pseudogene)
  Uniprot ID: Q8NH92
  ENST ID: ENST00000624482
  CDS Start-End: 1-978

SEQ ID NO: 161932 - DNA, 980 bp, Homo sapiens
  Payload ID: 11636
  Gene Symbol: OR1S2
  Gene Name: olfactory receptor, family 1, subfamily S, member 2
  Uniprot ID: Q8NGQ3
  ENST ID: ENST00000302592
  CDS Start-End: 1-978
atgaagactttgtgttcctttcttcagatcagcagaaatatgcatcaagaaaaccaaaccaccatcactgaattcattctcctgggactctccaaccaggctgaacatcaaaacctcctctttgtgcttttcctgagtatgtatgtggtcactgtggttgggaacgggctcatcattgtggctatcagcttggatatataccttcacacccccatgtatctcttccttgcctacctatcctttgctgatatttcctccatttccaactcagtccccaaaatgctggtgaatattcaaaccaacagccaatccatctcttatgagagctgcatcacacagatgtacttttctattgtgtttgtcgtcactgacaatttgcttttggggaccatggccttcgaccactttgtggcgatctgccaccctctgaactatacaactttcatgcgggccaggttcggcactttgctcacagtcatctcgtggttcctcagtaatattattgctcttacacacacccttctgctcattcaattgctcttctgtgaccacaacactctcccacacttcttctgtgacttggcccctctgctcaaactgtcctgttcagatacaatgatcaatgagcttgtgttgtttattgtgggtttatcagttatcatcttcccctttgtactcatcttcttctcctatgtctgcatcatcagagctgtcctgggagtatcatccacacagggaaagtggaaagccttctccacttgtggctctcacctgacaattgcattactgttctacggaaccactgtaggcgtgtactttttcccctcctccactcaccctgaggacactgataagattggtgctgtcctattcactgtggtgacacccatgatgaaccccttcatctacagcttgaggaataaggatatgaaaggtgccctgagaaagctcatcaatagaaaaatttcttccctttgatg

SEQ ID NO: 161933 - DNA, 1053 bp, Homo sapiens
  Payload ID: 11637
  Gene Symbol: OR10A2
  Gene Name: olfactory receptor, family 10, subfamily A, member 2
  Uniprot ID: Q9H208
  ENST ID: ENST00000307322
  CDS Start-End: 63-974
ggggacttctgcccacacttatagctacaggaaactggacaagaataagtgagtttatcctcatgagcttctcttccctgcctactgaaatacagtcattactctttctgacatttctaaccatctacctggtcaccctgatgggaaactgcctcatcattctggttaccctagctgaccccatgctacacagccccatgtacttcttcctcagaaacttatctttcctggagattggcttcaacctagtcattgtgcccaaaatgctggggaccctgcttgcccaggacacaaccatctccttccttggctgtgccactcagatgtatttcttcttcttctttggagtggctgaatgcttcctcctggctaccatggcatatgaccgctatgtggccatctgcagtcccttgcactacccagtcatcatgaaccaaaggactcgtgccaaactggctgctgcctcctggttcccaggctttcctgtagctactgtgcagaccacatggctcttcagttttccattctgtggcaccaacaaggtgaaccacttcttctgtgacagcccacctgtgctgaggctggtctgtgcagacacagcactctttgagatctacgccatcgtcggaaccattctggtggtcatgatcccctgcttgctgatcttgtgttcctatactcacattgctgctgccatcctcaagatcccatcagctaaagggaagaataaagccttttctacatgttcctcacacctccttgttgtctctcttttctatatatcattaagcctcacctacttccggcctaaatcaaataattcacctgagggcaagaagctgctatcattgtcctacactgttatgactcccatgttgaaccccattatctacagcctgagaaataacgaggtgaagaatgccctcagcaggacggtctctaaggccctagccctcagaaactgtatcccatagaccttaggaagtaaggctacattttactggatgagaaacaatcagtcccagatttgagattcctctctgcatctttcca

SEQ ID NO: 161934 - DNA, 1061 bp, Homo sapiens
  Payload ID: 11638
  Gene Symbol: OR10A3
  Gene Name: olfactory receptor, family 10, subfamily A, member 3
  Uniprot ID: P58181
  ENST ID: ENST00000360759
  CDS Start-End: 75-1019
tcacagctatgggattacgacttcatactcgatataccaggtccataaaaacaatataagtttcaactactgaaatgaaaagacaaaatcaaagctgtgtggttgaattcatcctcctgggcttttctaactttcctgagctccaggtgcagctctttggggttttcctagttatttatgtggtgaccctgatgggaaatgccatcattacagtcatcatctccttaaaccagagcctccacgttcccatgtacctgttcctcctgaacctatctgtggtggaggtgagtttcagtgcagtcattacgcctgaaatgctggtggtgctctctactgagaaaactatgatttcttttgtgggctgttttgcacagatgtatttcatccttctttttggtgggactgaatgttttctcctgggagcgatggcttatgaccgatttgctgcaatttgccatcctctgaactacccagtgattatgaacagaggggtttttatgaaattagtaatattctcatggatctcagggatcatggtggctactgtgcagaccacttgggtatttagttttccattttgtggccccaatgaaattaatcatctcttctgtgagactcccccggtactagagcttgtgtgtgcagacaccttcttatttgaaatctatgccttcacaggcaccattttgattgttatggttcctttcttgttgatcctcttgtcttacattcgagttctgtttgccatcctgaagatgccatcaactactgggagacaaaaggccttttccacctgtgcctctcacctcacatctgtgaccctgttctatggcacagccaatatgacttatttacaacccaaatctggctactcacccgaaaccaagaaactgatctcattggcttacacgttgcttacccctctgctcaatccgctcatctatagcttacgaaacagtgagatgaagaggactttgataaaactatggcgaagaaaagtgattttacacacattctgattgtgttgagaagctgagtaagatttggccactgcctgagtg

SEQ ID NO: 161935 - DNA, 1061 bp, Homo sapiens; identical to SEQ ID NO: 161934
  Payload ID: 11638
  Gene Symbol: OR10A3
  Gene Name: olfactory receptor, family 10, subfamily A, member 3
  Uniprot ID: P58181
  ENST ID: ENST00000612788
  CDS Start-End: 75-1019

SEQ ID NO: 161936 - DNA, 1061 bp, Homo sapiens; identical to SEQ ID NO: 161934
  Payload ID: 11638
  Gene Symbol: OR10A3
  Gene Name: olfactory receptor, family 10, subfamily A, member 3
  Uniprot ID: P58181
  ENST ID: ENST00000626843
  CDS Start-End: 75-1019

SEQ ID NO: 161937 - DNA, 995 bp, Homo sapiens
  Payload ID: 11639
  Gene Symbol: OR10A4
  Gene Name: olfactory receptor, family 10, subfamily A, member 4
  Uniprot ID: Q9H209
  ENST ID: ENST00000379829
  CDS Start-End: 24-971
ccagtgaagtcctgggcagaagaatgatgtgggaaaactggacaattgtcagtgaatttgttctcgtgagcttctcagccctgtccactgagcttcaggctctactgtttctccttttcttgaccatttacttggttactttaatgggcaatgtcctcatcatcctggtcactatagctgactctgcactacaaagtcctatgtacttcttcctcagaaacttgtccttcctggagataggtttcaacttggtcattgtgcccaagatgctggggaccctgatcattcaagacacaaccatctccttccttggatgtgccactcagatgtatttcttcttcttttttggggctgctgagtgctgcctcctggccaccatggcatatgaccgctacgtggccatctgtgaccccttgcactacccagtcatcatgggccacatatcctgtgcccagctggcagctgcctcttggttctcagggttttcagtggccactgtgcaaaccacatggattttcagtttccctttttgtggccccaacagggtgaaccacttcttctgtgacagccctcctgttattgcactggtctgtgctgacacctctgtgtttgaactggaggctctgacagccactgtcctattcattctctttcctttcttgctgatcctgggatcctatgtccgcatcctctccactatcttcaggatgccgtcagctgaggggaaacatcaggcattctccacctgttccgcccacctcttggttgtctctctcttctatagcactgccatcctcacgtatttccgaccccaatccagtgcctcttctgagagcaagaagctgctgtcactctcttccacagtggtgactcccatgttgaaccccatcatctacagctcaaggaataaagaagtgaaggctgcactgaagcggcttatccacaggaccctgggctctcagaaactatgattggcttagatggaaactgaaggg

SEQ ID NO: 161938 - DNA, 1054 bp, Homo sapiens
  Payload ID: 11640
  Gene Symbol: OR10A5
  Gene Name: olfactory receptor, family 10, subfamily A, member 5
  Uniprot ID: Q9H207
  ENST ID: ENST00000299454
  CDS Start-End: 32-985
ggaccacagctggggatttatgcccatacttatggctataggaaactggacagaaataagtgaatttatcctcatgagcttctcttccctacctactgaaatacagtcattgctcttcctgacatttctaactatctatttggttactctgaagggaaacagcctcatcattctggttaccctagctgaccccatgctacacagccccatgtacttcttcctcagaaacttatctttcctggagattggcttcaacctagtcattgtgcccaaaatgctggggaccctgcttgcccaggacacaaccatctccttccttggctgtgccactcagatgtatttcttcttcttctttggggtagctgaatgcttcctcctggctaccatggcatatgaccgctatgtggccatctgcagtcccttgcactacccagtcatcatgaaccaaaggacacgggccaaactggctgctgcttcctggttcccaggctttcctgtagctactgtgcagaccacatggctcttcagttttccattctgtggcaccaacaaggtgaaccacttcttctgtgacagcccgcctgtgctgaagctggtctgtgcagacacagcactgtttgagatctacgccatcgtcggaaccattctggtggtcatgatcccctgcttgctgatcttgtgttcctatactcgcattgctgctgctatcctcaagatcccatcagctaaagggaagcataaagccttctctacgtgctcctcacacctccttgttgtctctcttttctatatatcttctagcctcacctacttctggcctaaatcaaataattctcctgagagcaagaagttgttatcattatcctacactgttgtgactcccatgttgaaccccattatctacagcttgagaaatagcgaggtgaagaatgccctcagcaggaccttccacaaggtcctagccctcagaaactgtatcccatagaccttaggaagtaaggctaaattctattgaatgacaattagtttcatgtttgggacacctctctgcctc

SEQ ID NO: 161939 - DNA, 945 bp, Homo sapiens; identical to SEQ ID NO: 161874
  Payload ID: 11641
  Gene Symbol: OR10A6
  Gene Name: olfactory receptor, family 10, subfamily A, member 6 (gene/pseudogene)
  Uniprot ID: Q8NH74
  ENST ID: ENST00000309838
  CDS Start-End: 1-945

SEQ ID NO: 161940 - DNA, 951 bp, Homo sapiens
  Payload ID: 11642
  Gene Symbol: OR10A7
  Gene Name: olfactory receptor, family 10, subfamily A, member 7
  Uniprot ID: Q8NGE5
  ENST ID: ENST00000326258
  CDS Start-End: 1-951
atgatctgtgaaaatcacaccagagtcactgaatttattcttcttggttttacaaacaaccccgagatgcaagtttccctctttatttttttcctggccatttatacagtcactttgttgggcaactttcttattgtcacagttaccagtgtggatctcgcacttcaaacacccatgtacttctttcttcaaaatctgtcacttcttgaagtatgtttcaccttggttatggtgccaaaaatgcttgtagatctagtgtccccaaggaaaattatctcttttgtgggctgtggtacccagatgtacttcttcttcttctttggcagttctgaatgtttccttctctccatgatggcttatgatcgctttgtggccatctgtaaccctctccattattcagtcataatgaacaggtccctatgcttgtggatggccataggctcttggatgtccggtgttcctgtgtctatgctacagacagcttggatgatggcccttcctttctgtggaccaaatgccgtggaccactttttctgtgatggtcccccagtgttaaaactagtcacagtggatacaaccatgtatgaaatgcaagcacttgcctccacactcctgtttatcatgtttcccttttgtctcattttggtttcctacacccgcattatcataacaattctgaggatgtcctctgccactggccgccagaaggcattttctacttgttcctcacacctcattgtggtgtccctcttctacggaacagccagtctgacctacctgcggcccaaatcaaaccagtcccctgagagcaagaagctagtgtcattgtcctacactgtcatcacacctatgctaaaccccatcatctacggcctgaggaacaatgaagtgaaaggggctgtcaagaggacaatcactcaaaaagtcttacagaagttagatgtgttttga

SEQ ID NO: 161941 - DNA, 979 bp, Homo sapiens
  Payload ID: 11643
  Gene Symbol: OR10AC1
  Gene Name: olfactory receptor, family 10, subfamily AC, member 1 (gene/pseudogene)
  ENST ID: ENST00000439431
  CDS Start-End: 1-979
atggacagtcccagcaatgccaccgtgccctgtggctttctccttcaaggcttctccgaattcccgcacctgagacccgtgctcttccttttgctgctgggggtgcacctggccaccctgggcgggaacctgctcatcctggtggccgtggcctcgatgccaagccggcagcccatgctgctcttcctgtgccagctgtcagccatcgagctgtgctacacgctggtggtggtgccccgctccctggtcgacctgagcacgccggggccaccgcaggggcagccctatctccttcctgagctgcgcctttcagatgcagatgtttgtggctctgggcggggccgagtgcttcctgctggccgccatggcctatgaccgctacgtggccatctgccacccgttgcgctacgcggccgtggtgacccccgggctgtgcgcgcgactggctctggcctgctgcctcaggggactggcggtgtccgtggggctcacggtggccatcttccacctgcctttctgcggctcccgcctgctgctgcacttcttctgcgacatcacggcgctgctgcacctggcctgcacgcggagctacgccgacgagctgcctctgctgggcgcctgcctggtgctgctgctgctgccctcggtgctcatcctggcctcctatggcgccatcgccgccgccctgcgccgcctgcgctgccccaaaggccggggcaaggccgcctccacctgcgccttgcacctggcagtcaccttcctgcactacggctgcgccaccttcatgtacgtgcggcccagggccagctactccccgcgcctggaccgcaccctggcgctggtctacaccaacgtcacgccgctgctgtgcccactcatctacagcctgcgcaaccgcgagatcaccgccgccctgagcagggtgctggggcgccggcggccaggccaagctccaggcggggatctgcgcgagctctga

SEQ ID NO: 161942 - DNA, 1305 bp, Homo sapiens
  Payload ID: 11644
  Gene Symbol: OR10AD1
  Gene Name: olfactory receptor, family 10, subfamily AD, member 1
  Uniprot ID: Q8NGE0
  ENST ID: ENST00000310248
  CDS Start-End: 96-1049
aattgggcttctgggaccaagtgggtaccttctattaccccacagctatacccttgtgcttttcccatcatctttcctcctcaaacaggccccagatgctaaggaatggcagcatagtgacggaatttatcctcgtgggctttcagcagagctccacttccacacgagcattgctctttgccctcttcttggccctctacagcctcaccatggccatgaatggcctcatcatctttatcacctcctggacagaccccaagctcaacagccccatgtacttcttcctcggccatctgtctctcctggatgtctgcttcatcaccactaccatcccacagatgttgatccacctcgtggtcagggaccacattgtctcctttgtatgttgcatgacccagatgtactttgtcttctgtgttggtgtggccgagtgcatcctcttggctttcatggcctatgaccgttatgttgctatctgctacccacttaactatgtcccgatcataagccagaaggtctgtgtcaggcttgtgggaactgcctggttctttgggctgatcaatggcatctttctcgagtatatttcattccgagagcccttccgcagagacaaccacatagaaagcttcttctgtgaggcccccatagtgattggcctctcttgtggggaccctcagtttagtctgtgggcaatctttgccgatgccatcgtggtaattctcagccccatggtgctcactgtcacttcctatgtgcacatcctggccaccatcctcagcaaagcctcctcctcaggtcgggggaagactttctctacttgtgcctctcacctgactgtggtcatctttctctacacttcagctatgttctcttacatgaacccccacagcacacatgggcctgacaaagacaaacctttctccctcctgtacaccatcattacccccatgtgcaaccccatcatttatagtttccgcaacaaggaaattaaggaggccatggtgagggcacttggaagaaccaggctggcccagccacagtctgtctagcaggaaggccctgaaaggaaagctccttcacctggggaatgggagagttaccccatccccagccctggcagatgagtaactctcctatgctgaaaggctccaggaaagagcgttcatggcttccttggcactagaatcagacctgaaagttcctcctgatgtccaatgtcctgatgttatctctctgacttcacttccacattgttttttcttggaccttcctcgggagaatttcggattttccttagtttttttc

SEQ ID NO: 161943 - DNA, 906 bp, Homo sapiens
  Payload ID: 11645
  Gene Symbol: OR10AG1
  Gene Name: olfactory receptor, family 10, subfamily AG, member 1
  Uniprot ID: Q8NH19
  ENST ID: ENST00000312345
  CDS Start-End: 1-906
atggaatttgttcttttggggttttctgatattcccaatctccactggatgctttttagtatatttttacttatgtatttgatgatcctgatgtgcaatggcatcataatactactaataaaaattcaccccgctctccagactcccatgtatttttttcttagcaatttttcccttttggaaatctgttatgtaacaatcattatcccaagaatgctcatggacatttggactcagaaaggaaatatttctttgtttgcttgtgctacacaaatgtgtttttttcttatgcttggaggcacggagtgtctccttctgacagtgatggcctatgaccgctacgtggctatttgtaagcctttgcagtatcctctagtgatgaaccacaaagtctgcattcagctgataatagcttcctggaccatcacaattcctgtagtaattggggaaacatgccaaattttccttttgcccttttgcggaactaacacaattaatcatttcttttgtgacatcccgccaatactcaagcttgcttgtggaaacatatttgtgaatgagataacagtccatgtagtagcggtggtgtttatcacggtgccatttctgttgattgttgtctcttatggcaaaattatctccaacattttgaaattgtcatcagccagaggaaaggctaaagccttctccacctgctcatctcacctaatagttgtaatcttattctttggagcaggtactatcacttatttacagcccaaaccacatcagtttcaaaggatggggaaactgatttctcttttctacaccattctgattccaactttgaatcctattatatataccctgaggaacaaagatatcatggtggcattgagaaaattactagctaagttattaacatga

SEQ ID NO: 161944 - DNA, 1649 bp, Homo sapiens
  Payload ID: 11646
  Gene Symbol: OR10C1
  Gene Name: olfactory receptor, family 10, subfamily C, member 1 (gene/pseudogene)
  Uniprot ID: Q96KK4
  ENST ID: ENST00000377138
  CDS Start-End: 711-1649
cagaaataagcaattaaggaagttcttgtcatcttttgcctgagcatgttttaaaactagagaaatgctcacccctctaaatagttgaactgtttaatgctataggagcttaaaaagagaggatctttctcattttttttctcctccttgaacactgtgaaatttatggtaaaatgacagaaaaagaagaaagactaagtgaatctggtaactaaagaaagagctggaaaaaagaaaactagagggcaagaggtgataagagaggtcacctcttatcagacaggagacaagttgatggagaaaaagatctgctatgagggaaaattctgtctccagccctgcaggaagaattggaaaatcagaaaagagtgaaaagggagctagactgacttaatcttcagcccaggtaaaactggaaagacagtttaacatgttctttagaatgataggcactatcaggaagagatgaagtcagggattcaggctcagagagacaaatactcatccaggatcccaagagtgagcaagggtggaatatggactccaggcaaggctgcctaatttcaaagtccatgatattctaatagaaagggagatctagtgctgcgatcagatgcagagagaggtcatctttgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcatggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 161945 - DNA, 1649 bp, Homo sapiens; identical to SEQ ID NO: 161944
  Payload ID: 11646
  Gene Symbol: OR10C1
  Gene Name: olfactory receptor, family 10, subfamily C, member 1 (gene/pseudogene)
  Uniprot ID: Q96KK4
  ENST ID: ENST00000391549
  CDS Start-End: 711-1649

SEQ ID NO: 161946 - DNA, 1649 bp, Homo sapiens
  Payload ID: 11646
  Gene Symbol: OR10C1
  Gene Name: olfactory receptor, family 10, subfamily C, member 1 (gene/pseudogene)
  Uniprot ID: Q96KK4
  ENST ID: ENST00000455234
  CDS Start-End: 711-1649
cagaaataagcaattaaggaagttcttgtcatcttttgcctgagcatgttttaaaactagagaaatgctcacccctctaaatagttgaactgtttaatgctataggagcttaaaaagagaggatctttctcattttttttctcctccttgaacactgtgaaatttatggtaaaatgacagaaaaagaagaaagactaagtgaatctggtaactaaagaaagagctggaaaaaagaaaactagagggcaagaggtgataagagaggtcacctcttatcagacaggagacaagttgatggagaaaaagatctgctatgagggaaaattctgtctccagccctgcaggaagaattggaaaatcagaaaagagtgaaaagggagctagactgacttaatcttcagcccaggtaaaactggaaagacagtttaacatgttctttagaatgataggcactatcaggaagagatgaagtcagggattcaggctcagagagacaaatactcatccaggatcccaagagtgagcaagggtggaatatggactccaggcaaggctgcctaatttcaaagtccatgatattctaatagaaagggagatctagtgctgcgatcagatgcagagagaggtcatctttgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 161947 - DNA, 1649 bp, Homo sapiens
  Payload ID: 11646
  Gene Symbol: OR10C1
  Gene Name: olfactory receptor, family 10, subfamily C, member 1 (gene/pseudogene)
  ENST ID: ENST00000428644
  CDS Start-End: 711-1649
cagaaataagcaattaaggaagttcttgtcatcttttgcctgagcatgttttaaaactagagaaatgctcacccctctaaatagttgaactgtttaatgctataggagcttaaaaagagaggatctttctcattttttttctcctccttgaacactgtgaaatttatggtaaaatgacagaaaaagaagaaagactaagtgaatctggtaactaaagaaagagctggaaaaaagaaaactagagggcaagaggtgataagagaggtcacctcttatcagacaggagacaagttgatggagaaaaagatctgctatgagggaaaattctgtctccagccctgcaggaagaattggaaaatcagaaaagagtgaaaagggagctagactgacttaatcttcagcccaggtaaaactggaaagacagtttaacatgttctttagaatgataggcactatcaggaagagatgaagtcagggattcaggctcagagagacaaatactcatccaggatcccaagagtgagcaagggtggaatatggactccaggcaaggctgcctaatttcaaagtccatgatattctaatagaaagggagatctagtgctgcgatcagatgcagagagaggtcatctttgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacctcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatccagcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 161948 - DNA, 1649 bp, Homo sapiens; identical to SEQ ID NO: 161946
  Payload ID: 11646
  Gene Symbol: OR10C1
  Gene Name: olfactory receptor, family 10, subfamily C, member 1 (gene/pseudogene)
  Uniprot ID: Q96KK4
  ENST ID: ENST00000437403
  CDS Start-End: 711-1649

SEQ ID NO: 161949 - DNA, 1649 bp, Homo sapiens; identical to SEQ ID NO: 161946
  Payload ID: 11646
  Gene Symbol: OR10C1
  Gene Name: olfactory receptor, family 10, subfamily C, member 1 (gene/pseudogene)
  Uniprot ID: Q96KK4
  ENST ID: ENST00000457403
  CDS Start-End: 711-1649

SEQ ID NO: 161950 - DNA, 1649 bp, Homo sapiens; identical to SEQ ID NO: 161944
  Payload ID: 11646
  Gene Symbol: OR10C1
  Gene Name: olfactory receptor, family 10, subfamily C, member 1 (gene/pseudogene)
  Uniprot ID: Q96KK4
  ENST ID: ENST00000444197
  CDS Start-End: 711-1649

SEQ ID NO: 161951 - DNA, 1649 bp, Homo sapiens; identical to SEQ ID NO: 161946
  Payload ID: 11646
  Gene Symbol: OR10C1
  Gene Name: olfactory receptor, family 10, subfamily C, member 1 (gene/pseudogene)
  ENST ID: ENST00000503212
  CDS Start-End: 711-1649

SEQ ID NO: 161952 - DNA, 1039 bp, Homo sapiens
  Payload ID: 11646
  Gene Symbol: OR10C1
  Gene Name: olfactory receptor, family 10, subfamily C, member 1 (gene/pseudogene)
  ENST ID: ENST00000552057
  CDS Start-End: 72-1016
tgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttgaaaagggggcgatagtgacttctg

SEQ ID NO: 161953 - DNA, 1039 bp, Homo sapiens; identical to SEQ ID NO: 161952
  Payload ID: 11646
  Gene Symbol: OR10C1
  Gene Name: olfactory receptor, family 10, subfamily C, member 1 (gene/pseudogene)
  ENST ID: ENST00000552404
  CDS Start-End: 72-1016

SEQ ID NO: 161954 - DNA, 1039 bp, Homo sapiens; identical to SEQ ID NO: 161952
  Payload ID: 11646
  Gene Symbol: OR10C1
  Gene Name: olfactory receptor, family 10, subfamily C, member 1 (gene/pseudogene)
  ENST ID: ENST00000551349
  CDS Start-End: 72-1016

SEQ ID NO: 161955 - DNA, 1039 bp, Homo sapiens; identical to SEQ ID NO: 161952
  Payload ID: 11646
  Gene Symbol: OR10C1
  Gene Name: olfactory receptor, family 10, subfamily C, member 1 (gene/pseudogene)
  ENST ID: ENST00000552782
  CDS Start-End: 72-1016

SEQ ID NO: 161956 - DNA, 1039 bp, Homo sapiens
  Payload ID: 11646
  Gene Symbol: OR10C1
  Gene Name: olfactory receptor, family 10, subfamily C, member 1 (gene/pseudogene)
  ENST ID: ENST00000546473
  CDS Start-End: 72-1016
tgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcatggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttgaaaagggggcgatagtgacttctg

SEQ ID NO: 161957 - DNA, 1039 bp, Homo sapiens
  Payload ID: 11646
  Gene Symbol: OR10C1
  Gene Name: olfactory receptor, family 10, subfamily C, member 1 (gene/pseudogene)
  ENST ID: ENST00000550132
  CDS Start-End: 72-1016
tgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacctcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatccagcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttgaaaagggggcgatagtgacttctg

SEQ ID NO: 161958 - DNA, 1039 bp, Homo sapiens; identical to SEQ ID NO: 161956
  Payload ID: 11646
  Gene Symbol: OR10C1
  Gene Name: olfactory receptor, family 10, subfamily C, member 1 (gene/pseudogene)
  ENST ID: ENST00000550017
  CDS Start-End: 72-1016

SEQ ID NO: 161959 - DNA, 1039 bp, Homo sapiens; identical to SEQ ID NO: 161956
  Payload ID: 11646
  Gene Symbol: OR10C1
  Gene Name: olfactory receptor, family 10, subfamily C, member 1 (gene/pseudogene)
  ENST ID: ENST00000622521
  CDS Start-End: 72-1016

SEQ ID NO: 161960 - DNA, 939 bp, Homo sapiens
  Payload ID: 11646
  Gene Symbol: OR10C1
  Gene Name: olfactory receptor, family 10, subfamily C, member 1 (gene/pseudogene)
  ENST ID: ENST00000623086
  CDS Start-End: 1-939
atgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcatggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 161961 - DNA, 1030 bp, Homo sapiens
  Payload ID: 11647
  Gene Symbol: OR10D3
  Gene Name: olfactory receptor, family 10, subfamily D, member 3 (non-functional)
  Uniprot ID: Q8NH80
  ENST ID: ENST00000318666
  CDS Start-End: 55-993
caaggcattcttccatgtcctcagcctcctctttccttcctaggactggcttccatggaggtgaagaactgctgcatggtgacagagttcatccttttgggaatcccacacacagaggggctggagatgacactttttgtcttattcttgcccttctatgcctgcactctactgggaaatgtgtctatccttgttgctgttatgtcttctgctcgccttcacacacctatgtatttcttcctgggaaacttgtctgtgtttgacatgggtttctcctcagtgacttgtcccaaaatgctgctctaccttatggggctgagccgactcatctcctacaaagactgtgtctgccagcttttcttcttccatttcctcgggagcattgagtgcttcttgtttacggtgatggcctatgaccgcttcactgccatctgttatcctctgcgatacacagtcatcatgaacccaaggatctgtgtggccctggctgtgggcacatggctgttagggtgcattcattccagtatcttgacctccctcaccttcaccttgccatactgtggtcccaatgaagtggatcacttcttctgtgacattccagcactgttgcccttggcctgtgctgacacatccttagcccagagggtgagcttcaccaacgttggcctcatatctcttgtctgctttctgctaattcttttatcctacactagaatcacaatatctatcttaagcattcgtacaactgagggccgtcgccgtgccttctccacctgcagtgctcacctcattgccatcctctgtgcctatgggcccatcatcactgtctacctgcagcccacacccaaccccatgctgggaaccgtggtacaaattctcatgaatctggtaggaccaatgctgaaccctttgatctataccttgaggaataaggaagtaaaaacagccctgaaaacaatattgcacaggacaggccatgttcctgagagttagtaagagcagataaatgggtgcatggctctggaattcc

SEQ ID NO: 161962 - DNA, 1105 bp, Homo sapiens
  Payload ID: 11648
  Gene Symbol: OR10G2
  Gene Name: olfactory receptor, family 10, subfamily G, member 2
  Uniprot ID: Q8NGC3
  ENST ID: ENST00000542433
  CDS Start-End: 99-1031
ggcatcaatcatccgacaaaagcattcacttacaacatcattgtgctgtgtttctcttgtcaaacgtcaccattcatcttagcagactacaaaaagacatgggaaagaccaaaaacacatcgctggatgccgtggtgacagatttcattcttctgggtttgtctcaccccccaaatctaagaagcctcctcttcctggtcttcttcatcatttacatcctcactcagctggggaacctgctcattctgctcaccatgtgggctgacccgaagctctgtgctcgccccatgtacattcttctgggagtgctctcattcctggacatgtggctctcctcagtcaccgttcctctgcttattttggattttactccttccatcaaggctatcccgtttggtggctgtgtggctcaactgtatttctttcacttcctgggcagcacccagtgcttcctctacaccttgatggcctatgacaggtacctggcaatatgtcagcccctgcgctacccagtgctcatgaatgggaggttatgcacagtccttgtggctggagcttgggtcgccggctccatgcatgggtctatccaggccaccttgaccttccgcctgccctactgtgggcccaatcaggtggattactttatctgtgacatccccgcagtattgagactggcctgtgctgacacaactgtcaatgagcttgtgacctttgtggacgtcggggtagtggccgccagttgcttcatgttaattctgctctcgtatgccaacatagtaaatgccatcctgaagatacgcaccactgatgggaggcgccgggccttctccacctgtggctcccacctaatcgtggtcacagtctactatgtcccctgtattttcatctaccttagggctggctccaaagaccccctggatggggcagcggctgtgttttacactgttgtcactccattactgaaccccctcatctatacactgaggaaccaggaagtgaagtctgccctgaagaggataacagcaggttgaaggactgaatgaaaataagtaactacatctgcatcattatcactgccactctcttcagctactgctgcatgtga

SEQ ID NO: 161963 - DNA, 942 bp, Homo sapiens
  Payload ID: 11649
  Gene Symbol: OR10G3
  Gene Name: olfactory receptor, family 10, subfamily G, member 3
  Uniprot ID: Q8NGC4
  ENST ID: ENST00000303532
  CDS Start-End: 1-942
atggaaagaatcaacagcacactgttgactgcgtttatcctgacaggaattccgtatccactcaggctaaggacactcttttttgtgttcttttttctaatctacatcctgactcagctgggaaacctgcttattttaatcactgtctgggcagacccaaggctccatgcccgccccatgtacatctttcttggtgttctctcagtcattgatatgagcatctcctccatcattgtccctcgcctcatgatgaacttcactttaggtgtcaaacccatcccatttggtggctgtgttgctcaactctatttctatcacttcctgggcagcacccagtgcttcctctacaccctaatggcctatgacaggtacctggcaatatgtcagcccctgcgctaccctgtgctcatgactgctaagctgagcgccttgcttgtggctggagcctggatggcaggatccatccatggggctctccaggccatcctaaccttccgcctgccctactgtgggcccaatcaggtggattacttcttctgtgacatccctgcagtgttgagactggcctgtgctgacacaacagtcaacgagctggtgacgtttgtagacattggggtggtggttgccagttgcttctccctgatcctcctctcctacatacagatcattcaggccatcctgagaatccacacagctgatgggcggcgccgggctttttcaacttgtggagcccatgtaaccgtggtcaccgtgtactatgtgccctgtgccttcatctacctgaggcctgaaaccaacagccccctggatggggcagctgccctagtccccacggccatcactcctttcctcaacccccttatctacactctgcggaaccaagaggtgaagctggccctgaaaagaatgctcagaagcccaagaactccgagtgaggtttga

SEQ ID NO: 161964 - DNA, 936 bp, Homo sapiens
  Payload ID: 11650
  Gene Symbol: OR10G4
  Gene Name: olfactory receptor, family 10, subfamily G, member 4
  Uniprot ID: Q8NGN3
  ENST ID: ENST00000320891
  CDS Start-End: 1-936
atgtccaacgccagcctcgtgacagcattcatcctcacaggccttccccatgccccagggctggacgccctcctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcaggtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgtgatggtcatctttgtggacattgggatagtggcctcaggctgctttgtcctgatagtgctgtcctatgtgtccatcgtctgttccatcctgcggatccgcacctcagatgggaggcgcagagcctttcagacctgtgcctcccactgtattgtggtcctttgcttctttgttccctgtgttgtcatttatctgaggccaggctccatggatgccatggatggagttgtggccattttctacactgtgctgacgccccttctcaaccctgttgtgtacaccctgagaaacaaggaggtgaagaaagctgtgttgaaacttagagacaaagtagcacatcctcagaggaaataa

SEQ ID NO: 161965 - DNA, 999 bp, Homo sapiens
  Payload ID: 11651
  Gene Symbol: OR10G6
  Gene Name: olfactory receptor, family 10, subfamily G, member 6
  Uniprot ID: Q8NH81
  ENST ID: ENST00000307002
  CDS Start-End: 1-999
atgttagagggtgttgagcatctccttctgctacttcttttgacagatgtgaacagcaaggaactgcaaagtggaaaccagacttctgtgtctcacttcattttggtgggcctgcaccacccaccacagctgggagcgccactcttcttagctttccttgtcatctatctcctcactgtttctggaaatgggctcatcatcctcactgtcttagtggacatccggctccatcgtcccatgtgcttgttcctgtgtcacctctccttcttggacatgaccatttcttgtgctattgtccccaagatgctggctggctttctcttgggtagtaggattatctcctttgggggctgtgtaatccaactattttctttccatttcctgggctgtactgagtgcttcctttacacactcatggcttatgaccgtttccttgccatttgtaagcccttacactatgctaccatcatgacccacagagtctgtaactccctggctttaggcacctggctgggagggactatccattcacttttccaaacaagttttgtattccggctgcccttctgtggccccaatcgggtcgactacatcttctgtgacattcctgccatgctgcgtctagcctgcgccgatacggccatcaacgagctggtcacctttgcagacattggcttcctggccctcacctgcttcatgctcatcctcacttcctatggctatattgtagctgccatcctgcgaattccgtcagcagatgggcgccgcaatgccttctccacttgtgctgcccacctcactgttgtcattgtttactatgtgccctgcaccttcatttacctgcggccttgttcacaggagcccctggatggggtggtagctgtcttttacactgtcatcactcccttgcttaactccatcatctacacactgtgcaacaaagaaatgaaggcagcattacagaggctagggggccacaaggaagtgcagcctcactga

SEQ ID NO: 161966 - DNA, 945 bp, Homo sapiens
  Payload ID: 11652
  Gene Symbol: OR10G7
  Gene Name: olfactory receptor, family 10, subfamily G, member 7
  Uniprot ID: Q8NGN6
  ENST ID: ENST00000330487
  CDS Start-End: 10-945
tgagaagaaatgtccaacgccaccctactgacagcgttcatcctcacgggccttccccatgccccagggctggacgcccccctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcaggactatctccttccacagctgcgtggctcagctctattttttccacttcctggggagcaccgagtgtttcctctacacagtcatgtcctatgatcgctacctggccatcagttacccgctcaggtacaccaacatgatgactgggcgctcgtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgagatggtcatctttgtgaatattgggctagtggcctcgggctgctttgtcctgatagtgctgtcctatgtgtccatcgtctgttccatcctgcggatccgcacctcagaggggaggcacagagcctttcagacctgtgcctcccactgtatcgtggtcctttgcttctttggccctggtcttttcatttacctgaggccaggctccagggacgccttgcatggggttgtggccgttttctacaccacgctgactcctcttttcaaccctgttgtgtacaccctgagaaacaaggaggtaaagaaagctctgttgaagctgaaaaatgggtcagtatttgctcagggtgaatag

SEQ ID NO: 161967 - DNA, 1045 bp, Homo sapiens
  Payload ID: 11653
  Gene Symbol: OR10G8
  Gene Name: olfactory receptor, family 10, subfamily G, member 8
  Uniprot ID: Q8NGN5
  ENST ID: ENST00000431524
  CDS Start-End: 34-969
tcccagagggagagagaccaagggtgagaagaaatgtccaacgccagcctactgacagcgttcatcctcatgggccttccccatgccccagcgctggacgcccccctctttggagtcttcctggtggtttacgtgctcactgtgctggggaacctcctcatcctgctggtgatcagggtggattctcacctccacaccaccatgtactacttcctcaccaacctgtcgttcattgacatgtggttctccactgtcacggtgcccaaattgctgatgactttggtgttcccaagtggcagggctatctccttccacagctgcatggctcagctctatttctttcacttcctagggggcaccgagtgtttcctctacagggtcatgtcctgtgatcgctacctggccatcagttacccgctcaggtacaccagcatgatgactgggcgctcgtgtactcttctggccaccagcacttggctcagtggctctctgcactctgctgtccaggccatattgactttccatttgccctactgtggacccaactggatccagcactatttgtgtgatgcaccgcccatcctgaaactggcctgtgcagacacctcagccatagagactgtcatttttgtgactgttggaatagtggcctcgggctgctttgtcctgatagtgctgtcctatgtgtccatcgtctgttccatcctgcggatccgcacctcagaggggaagcacagagcctttcagacctgtgcctcccactgtatcgtggtcctttgcttctttggccctggtcttttcatttacctgaggccaggctccaggaaagctgtggatggagttgtggccgttttctacactgtgctgacgccccttctcaaccctgttgtgtacaccctgaggaacaaggaggtgaagaaagctctgttgaagctgaaagacaaagtagcacattctcagagcaaatagacactagggaagattacatatcttagctcttgtgaatagtgctgtgaaaaacatacaggggcaggtatcttttgga

SEQ ID NO: 161968 - DNA, 936 bp, Homo sapiens
  Payload ID: 11654
  Gene Symbol: OR10G9
  Gene Name: olfactory receptor, family 10, subfamily G, member 9
  Uniprot ID: Q8NGN4
  ENST ID: ENST00000375024
  CDS Start-End: 1-936
atgtccaagaccagcctcgtgacagcgttcatcctcacgggccttccccatgccccagggctggacgccccactctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcagatgtgccctcctggccaccagcacttggctcagtggctctctgcactctgctgtccagaccatattgactttccatttgccctactgtggacccaaccagatccagcactatttgtgtgatgcaccgcccatcctgaaactggcctgtgcagacacctcagccaacgagatggtcatctttgtggacattgggctagtggcctcgggctgctttctcctgatagtgctgtcttatgtgtccatcgtctgttccatcctgcggatccacacctcagaggggaggcacagagcctttcagacctgtgcctcccactgcatcgtggtcctttgcttttttgttccctgtgttttcatttacctgagaccaggctccagggacgtcgtggatggagttgtggccattttctacactgtgctgacaccccttctcaaccctgttgtgtacaccctgagaaacaaggaggtgaagaaagctgtgttgaaactgagagacaaagtagcacattctcagggagaataa

SEQ ID NO: 161969 - DNA, 1124 bp, Homo sapiens
  Payload ID: 11655
  Gene Symbol: OR10H1
  Gene Name: olfactory receptor, family 10, subfamily H, member 1
  Uniprot ID: Q9Y4A9
  ENST ID: ENST00000334920
  CDS Start-End: 90-1046
ggcaaatccaggtatggggaaggctgagaacttttcttcatgcagtaactgacatctccctgtcacatctcaccccaggcacagcctccatgcagagagccaatcactccacagtgacccaattcatcctcgtcggcttctctgtcttcccccacctccagctgatgctcttcctgctgttcctgctgatgtacctgttcacgctgctgggcaacctgctcatcatggccaccgtctggagcgagcgcagcctccacacgcccatgtacctcttcctgtgcgccctctccgtctccgagatcctctacaccgtggccatcatcccgcgcatgctggccgacctgctgtccacccagcgctccatcgccttcctggcctgtgccagtcagatgttcttctccttcagcttcggcttcacccactccttcctgctcaccgtcatgggctacgaccgctacgtggccatctgccaccccctgcgctacaacgtgctcatgagcccgcggggctgcgcctgcctggtgggctgctcctgggctggtggcttggtcatggggatggtggtgacctcggccattttccacctcgccttctgtggacacaaggagatccaccattttgcttgccatgtgccacctctgttgaagttggcctgtggagacgatgtgctggtggtggccaaaggcgtgggcttggtgtgtatcacggccctgctgggctgttttctcctcatcctcctctcctatgccttcatcgtggccgccatcttgaagatcccttctgctgaaggtcggaacaaggccttctccacctgtgcctctcacctcactgtggtggtcgtgcactatggctttgcctccgtcatttacctgaagcccaaaagtccccagtctctggaaggagacaccttgatgggcatcacctacacggtcctcacacccttcctcagccccatcatcttcagcctcaggaacaaggagctgaaggtcgccatgaagaagaccttcttcagtaaactctacccagaaaaaaatgtaatgatgtaggagaaattcactgggaacaactaaattggattaccgaaggctattgttaaaaattacgttccgtggtgactcatgcct

SEQ ID NO: 161970 - DNA, 1041 bp, Homo sapiens
  Payload ID: 11656
  Gene Symbol: OR10H2
  Gene Name: olfactory receptor, family 10, subfamily H, member 2
  Uniprot ID: O60403
  ENST ID: ENST00000305899
  CDS Start-End: 25-972
cttccccaactaggggtggccgtcatgctggggctaaaccacacctccatgtctgaattcatcctcgtcggcttctctgccttcccccacctccaactgatgctcttcctgctgttcctgctgatgtacctgttcacgctgctgggcaacctgctcatcatggccaccgtctggagcgagcgcagcctccacacgcccatgtacctcttcctgtgcgtcctctcagtctccgagatcctctacaccgtggccatcatcccgcgcatgctggccgacctgctgtccacccagcgctccatcgccttcctggcctgtgccagtcagatgttcttctccttcagcttcggcttcacccactccttcctgctcaccgtcatgggctacgaccgctacgtggccatctgccaccccctgcgctacaacgtgctcatgagcccacggggctgcgcctgcctggtgggctgctcctgggctggtggctcggtcatggggatggtggtgacctcggccattttccaactgactttctgtggatcccatgagatccagcattttttatgtcatgtgccacctctgttgaagttggcctgtggaaataatgtaccagctgtggccctgggcgtgggcttggtatgtatcatggcactgctgggctgttttctcctcatcctcctctcctatgccttcatcgtggccgacatcttgaagatcccttctgctgaaggtcggaacaaggccttctccacctgtgcctctcaccttattgtggtcattgtgcactatggctttgcctctgtcatctacctcaagcccaaaggtccccactctcaggagggtgacaccctgatggccaccacctacgcagtcctcacgcccttcctcagccccatcatcttcagcctcaggaacaaagaactgaaggttgccatgaagaggaccttcctcagcacactctattcctcaggcacctgagtagctggtgtggaagtgctgatagaatatgataggaggatgaccatcaccttgtctgcacagtgtggc

SEQ ID NO: 161971 - DNA, 951 bp, Homo sapiens
  Payload ID: 11657
  Gene Symbol: OR10H3
  Gene Name: olfactory receptor, family 10, subfamily H, member 3
  Uniprot ID: O60404
  ENST ID: ENST00000305892
  CDS Start-End: 1-951
atgcctggtcagaactacagaaccatatctgaatttatcctctctggcttctcagccttcccccagcagctcctgcctgtcttgttcctgctgtacctcctgatgttcctgttcacattgcttggcaaccttcttatcatggccacagtttggattgaacgcagactccacacacccatgtacctcttcttgtgtgccctctccatctctgagattctgttcactgttgccatcacccctcgcatgctggctgatctgctcttcacccatcgttccatcacctttgtggcttgtgccattcagatgttcttctccttcatgtttggcttcactcactccttccttctcatggtcatgggctatgatcactacgtgaccatctgccacccactgcattacaacatgctaatgagtccccgtggctgtgcccatcttgtggcctggacctgggctggtggctcggtcatggggatgatggtgacaatgatggtttttcacctcactttctgtgggtctaatgtgatccaccattttctctgtcatgtgctttccctcttgaagttggcctgtgggagcaagacatcatctgtcatcatgggtgtgatgctggtgtgtgtcacagccctgataggctgtttgttcctcatcatcctctcctttgtcttcattgtggctgccatcttgaggattccttctgctgagggccggcacaagactttctccacttgtgtatcccacctcactgtggtggtcatgcactatagttttgcctcccttatctacctcaaacccaagggcctccattctatgtacagtgatgccttgatggccaccacctatactgtcttcacccccttcctcagcccaatcattttcagtctaaggaacaaggagctgaagaatgccataaataaaaacttttgcagaaggttctgccctctaagctcctaa

SEQ ID NO: 161972 - DNA, 951 bp, Homo sapiens
  Payload ID: 11658
  Gene Symbol: OR10H4
  Gene Name: olfactory receptor, family 10, subfamily H, member 4
  Uniprot ID: Q8NGA5
  ENST ID: ENST00000322107
  CDS Start-End: 1-951
atgcctagtcagaactatagcatcatatctgaatttaacctctttggcttctcagccttcccccagcacctcctgcccatcttgttcctgctgtacctcctgatgttcctgttcacattgctgggcaaccttctcatcatggccacaatctggattgaacacagactccacacacccatgtacctcttcttgtgcaccctctccgtctctgagattctgttcactgttgccatcacccctcgcatgctggctgatctgctttccacccatcattccatcacctttgtggcttgtgccaaccagatgttcttctccttcatgtttggcttcactcactccttccttctcctggtcatgggctatgatcgctatgtggccatctgccacccactgcgttacaatgtgctcatgagcccccgtgactgtgcccatcttgtggcctgtacctgggctggtggctcagtcatggggatgatggtgacaacgatagttttccacctcactttctgtgggtctaatgtgatccaccattttttctgtcatgtgctttccctcttgaagttggcctgtgaaaacaagacatcatctgtcatcatgggtgtgatgctggtgtgtgtcacagccctgataggctgtttattcctcatcatcctctcctatgtcttcattgtggctgccatcttgaggattccctctgccgaaggccggcacaagacattttctacgtgtgtatcccacctcactgtggtggtcacgcactatagttttgcctcctttatctacctcaagcccaagggcctccattctatgtacagtgacgccttgatggccaccacctatactgtcttcacccccttccttagcccaatcattttcagcctaaggaacaaggagctgaagaatgccataaataaaaacttttacagaaaattctgtcctccaagttcctga

SEQ ID NO: 161973 - DNA, 1132 bp, Homo sapiens
  Payload ID: 11659
  Gene Symbol: OR10H5
  Gene Name: olfactory receptor, family 10, subfamily H, member 5
  Uniprot ID: Q8NGA6
  ENST ID: ENST00000308940
  CDS Start-End: 99-1046
cgctctcagatgtcctcccaggtgggagtcactagacacccctgtgctcctaaccactgggtcttctttcctctctccaccaactaggggtggccgccatgcaggggctaaaccacacctccgtgtctgaattcatcctcgttggcttctctgccttcccccacctccagctgatgctcttcctgctgttcctgctgatgtacctgttcacgctgctgggcaacctgctcatcatggccactgtctggagcgagcgcagcctccacatgcccatgtacctcttcctgtgtgccctctccatcaccgagatcctctacaccgtggccatcatcccgcgcatgctggccgacctgctgtccacccagcgctccatcgccttcctggcctgtgccagtcagatgttcttctccttcagcttcggcttcacccactccttcctgctcactgtcatgggctacgaccgctacgtggccatctgccaccccctgcgttacaacgtgctcatgagcctgcggggctgcacctgccgggtgggctgctcctgggctggtggcttggtcatggggatggtggtgacctcggccattttccacctcgccttctgtggacacaaggagatccaccatttcttctgccacgtgccacctctgttgaagttggcctgtggagatgatgtgctggtggtggccaaaggcgtgggcttggtgtgtatcacggccctgctgggctgttttctcctcatcctcctctcctatgccttcatcgtggccgccatcttgaagatcccttctgctgaaggtcggaacaaggccttctccacctgtgcctctcacctcactgtggtggtcgtgcactatggctttgcctccgtcatttacctgaagcccaaaggtccccagtctccggaaggagacaccttgatgggcatcacctacacggtcctcacacccttcctcagccccatcatcttcagcctcaggaacaaggagctgaaggtcgccatgaagaagacttgcttcaccaaactctttccacagaactgctgaaatggctgactttctctcaagagatgtagcgaatgggaacactttagtcttcctcctttatttcttttcctttcctccctccctcc

SEQ ID NO: 161974 - DNA, 1090 bp, Homo sapiens
  Payload ID: 11660
  Gene Symbol: OR10J1
  Gene Name: olfactory receptor, family 10, subfamily J, member 1
  Uniprot ID: P30954
  ENST ID: ENST00000423932
  CDS Start-End: 38-1000
tgtgcttctactgctttactgggactatgtgacttttatgcttttatgtttcagatttgggaaccaatccatgaaaagagagaactttactctcatcactgactttgttttccaaggtttctctagcttccatgagcagcagatcaccctttttggcgtgttccttgcactatacatcttaaccttagcaggcaatatcatcattgtgaccatcatccgaatggatcttcatcttcacacacccatgtacttcttcctgagcatgctgtccacttcagagactgtatatacattggtcattctcccaagaatgctctccagcctcgtaggtatgagccagcccatatcattggcagggtgtgccacacagatgttcttttttgtaacctttggcatcactaactgcttcctgctcacagcaatgggatatgaccgctatgtggccatctgcaaccccctgagatacatggttattatgaacaagaggctgcgtatccaacttgtcctgggggcctgcagcattgggctgattgtagcaataacgcaagtgacatctgtattcaggttacccttctgtgctagaaaggtgccccacttcttctgtgacatccgccctgtgatgaagctctcctgcattgacaccactgtcaatgaaatcctgactttgattatcagtgtgctggtgcttgttgtacctatgggtctggttttcatttcttatgttctcattatctctacaatcctcaagattgcttcagttgagggccggaagaaggcttttgccacctgtgcatcccacctcactgtggtcattgtccactacagctgtgcctccattgcctacctcaagcccaagtcagagaacaccagagaacatgaccagctgatctcggtgacctacactgtcatcactcccctactgaaccctgtggtatacaccctgagaaataaagaggtcaaagatgctctgtgcagggctgttggtgggaagttttcctgaccatgtaggaagagttctcctgaggctgtcaacatccacactaggcaggaatatgaggtgtaaactcacaaacacttggctcctagagac

SEQ ID NO: 161975 - DNA, 990 bp, Homo sapiens
  Payload ID: 11661
  Gene Symbol: OR10J3
  Gene Name: olfactory receptor, family 10, subfamily J, member 3
  Uniprot ID: Q5JRS4
  ENST ID: ENST00000332217
  CDS Start-End: 1-990
atgccaaagctaaattccacttttgtgactgagttcctctttgaaggtttctccagcttcaggcggcagcacaaacttgtcttctttgttgtcttcctaactttgtacctgctgactctctctggcaatgtgattatcatgaccattattcgcctggaccatcatcttcacacccccatgtacttcttcctgtgcatgctatccatctctgagacctgctacactgtggccatcattccccatatgctttctggtctcttgaatcctcatcagcccattgccacccaaagctgtgccactcagctcttcttctatctcacctttggcatcaacaactgcttcctgctcacagtcatgggatatgaccgctatgtggccatctgcaaccccctaaggtattcagtcatcatgggtaagagggcctgtatccaactggcctctggatcactggggattggccttggcatggccattgtccaagtaacatctgtgtttggcctgccattctgtgatgcctttgtcatctcccacttcttctgtgatgtgagacacctgctgaagctggcctgcacagacaccactgtcaatgagataatcaactttgttgtcagcgtctgtgtccttgttctacctatgggcctggtctttatctcctatgtcctcatcatctccaccattcttaagattgcctcagctgaaggtcagaagaaggcctttgccacctgcgcctcccacctcacagtggtcatcatccactatggctgtgcctccatcatctacctgaagcctaagtcccagagttccctgggacaggacagactcatctcagtgacctacactcatcactcccctactgaaccctgttgtgtacagcctgaagaacaaggaggtcaaagatgctctgcacagagccgtggggcaaaaaactctgtctccttaatgaagagaggttgtgaaggcttttcctttgcgtttataaatatgtactaa

SEQ ID NO: 161976 - DNA, 935 bp, Homo sapiens
  Payload ID: 11662
  Gene Symbol: OR10J4
  Gene Name: olfactory receptor, family 10, subfamily J, member 4 (gene/pseudogene)
  ENST ID: ENST00000504970
  CDS Start-End: 1-935
atgccaaggcccaatttcatggctgtgacagagtttacatttgagggtttctccatttttgagtggcatcacagactcatcctctttgtgatctttttggtcttgtacgttttgacccttgccagcaatgctatcatcttgatagttatccgccttaaccatcaacttcacacgcccatgtatttcttcctgagtgtgctgtctatttctgagacctattataccgtggccatcaacccccaaatgctgtccggtctcctcagtcctcaacaaaccatctccatcccaggctgtgccgctcagctctttttctatctcacttttggtgtcaataaatgcttcctgctcacagccatggggtatgaccactatgtggccatctgcaaccctctacagtattcagtcatcatgggcaaaaaggcttgtatacaactggtcagtggatcctggaacattggcctgagcacagctatcattcaggtgtcttctgtattcagccttcccttctgtgatgctaatctcatctcccacttcttttgtgatatccggcccataatgaagcttgcctgtgcagacactactatcaaggagttattactttgctcatcagtctctgtgtccttgttctgcccatggtattgatcttcatctcctatgtcctaattgtcaccaccatcctcaagattgcatcagctgagggcaggagaaaggcctttgctacttgtgcctcacacctcacagtggtcattgtccactatggccgtacttctttcatctacctaaaacccaaatcccaaaattccctgcaggacagacttatctctgtgacatacactgttattactcctctgctgaaccctgttgtatacagcctgaggaacaaagaggtcaaggatgccttgctcagagctttgggcagaaagcctctctcttag

SEQ ID NO: 161977 - DNA, 930 bp, Homo sapiens
  Payload ID: 11663
  Gene Symbol: OR10J5
  Gene Name: olfactory receptor, family 10, subfamily J, member 5
  Uniprot ID: Q8NHC4
  ENST ID: ENST00000334857
  CDS Start-End: 1-930
atgaagagaaagaacttcacagaagtgtcagaattcattttcttgggattttctagctttggaaagcatcagataaccctctttgtggttttcctaactgtctacattttaactctggttgctaacatcatcattgtgactatcatctgcattgaccatcatctccacactcccatgtatttcttcctaagcatgctggctagttcagagacggtgtacacactggtcattgtgccacgaatgcttttgagcctcatttttcataaccaacctatctccttggcaggctgtgctacacaaatgttcttttttgttatcttggccactaataattgcttcctgcttactgcaatggggtatgaccgctatgtggccatctgcagacccctgagatacactgtcatcatgagcaagggactatgtgcccagctggtgtgtgggtcctttggcattggtctgactatggcagttctccatgtgacagccatgttcaatttgccgttctgtggcacagtggtagaccacttcttttgtgacatttacccagtcatgaaactttcttgcattgataccactatcaatgagataataaattatggtgtaagttcatttgtgatttttgtgcccataggcctgatatttatctcctatgtccttgtcatctcttccatccttcaaattgcctcagctgagggccggaagaagacctttgccacctgtgtctcccacctcactgtggttattgtccactgtggctgtgcctccattgcctacctcaagccgaagtcagaaagttcaatagaaaaagaccttgttctctcagtgacgtacaccatcatcactcccttgctgaaccctgttgtttacagtctgagaaacaaggaggtaaaggatgccctatgcagagttgtgggcagaaatatttcttaa

SEQ ID NO: 161978 - DNA, 942 bp, Homo sapiens
  Payload ID: 11664
  Gene Symbol: OR10K1
  Gene Name: olfactory receptor, family 10, subfamily K, member 1
  Uniprot ID: Q8NGX5
  ENST ID: ENST00000289451
  CDS Start-End: 1-942
atggagcaagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactcccatgtacttcttccttgccatcctttcttgctctgagatttgctatacctttgtcattgtacccaagatgctggttgacctgctgtcccagaagaagaccatttctttcctgggctgtgccatccaaatgttttccttcctcttctttggctcctctcactccttcctgctggcagccatgggctatgatcgctatatggccatctgtaacccactgcgctactcagtgctcatgggacatggggtgtgtatgggactaatggctgctgcctgtgcctgtggcttcactgtctccctggtcaccacctccctagtatttcatctgcccttccactcctccaaccagctccatcacttcttctgtgacatctcccctgtccttaaactggcatctcagcactccggcttcagtcagctggtcatattcatgcttggtgtatttgccttggtcattcctctgctacttatcctagtctcctacatccgcatcatctctgccattctaaaaatcccttcctccgttggaagatacaagaccttctccacctgtgcctcccatctcattgtggtaactgttcactacagttgtgcctctttcatctacttaaggcccaagactaattacacttcaagccaagacaccctaatatctgtgtcatacaccatccttaccccattgttcaatccaatgatttatagtctgagaaataaggaattcaaatcagccctacgaagaacaatcggccaaactttctatcctcttagttaa

SEQ ID NO: 161979 - DNA, 939 bp, Homo sapiens
  Payload ID: 11665
  Gene Symbol: OR10K2
  Gene Name: olfactory receptor, family 10, subfamily K, member 2
  Uniprot ID: Q6IF99
  ENST ID: ENST00000314902
  CDS Start-End: 1-939
atggagcgggtcaatgagactgtggtgagagaggtcatcttcctcggcttctcatccctggccaggctgcagcagctgctctttgttatcttcctgctcctctacctgttcactctgggcaccaatgcaatcatcatttccaccattgtcctggacagggcccttcatatccccatgtacttcttccttgccatcctctcttgctctgagatttgctacaccttcatcattgtacccaagatgctggttgacctgctgtcccagaagaagaccatttctttcctgggctgtgccatccaaatgttttccttcctcttccttggctgctctcactcctttctgctggcagtcatgggttatgatcgttacatagccatctgtaacccactgcgctactcagtgctaatgggacatggggtgtgtatgggactagtggctgctgcctgtgcctgtggcttcactgttgcacagatcatcacatccttggtatttcacctgcctttttattcctccaatcaactacatcacttcttctgtgacattgctcctgtcctcaagctggcatctcaccataaccactttagtcagattgtcatcttcatgctctgtacattggtcctggctatccccttattgttgatcttggtgtcctatgttcacatcctctctgccatacttcagtttccttccacactgggtaggtgcaaagctttttctacctgtgtatctcacctcattattgtcactgtccactatggctgtgcctcctttatctacttaaggcctcagtccaactactcctcaagccaggatgctctaatatcagtatcctacactattataactccattgttcaacccaatgatttatagcttgagaaataaagagttcaaatcagctctttgtaaaattgtgagaagaacaatttccctgttgtaa

SEQ ID NO: 161980 - DNA, 995 bp, Homo sapiens
  Payload ID: 11666
  Gene Symbol: OR10P1
  Gene Name: olfactory receptor, family 10, subfamily P, member 1
  Uniprot ID: Q8NGE3
  ENST ID: ENST00000309675
  CDS Start-End: 33-974
cttggctgtgcctcagcttctggcctggagtgatggctggggaaaaccatactacactgcctgaattcctccttctgggattctctgacctcaaggccctgcagggccccctgttctgggtggtgcttctggtctacctggtcaccttgctgggtaactccctgatcatcctcctcacacaggtcagccctgccctgcactcccccatgtacttcttcctgcgccaactctcagtggtggagctcttctacaccactgacatcgtgcccaggaccctggccaatctgggctccccgcatccccaggccatctctttccagggctgtgcagcccagatgtacgtcttcattgtcctgggcatctcggagtgctgcctgctcacggccatggcctatgaccgatatgttgccatctgccagcccctacgctattccaccctcttgagcccacgggcctgcatggccatggtgggtacctcctggctcacaggcatcatcacggccaccacccatgcctccctcatcttctctctaccttttcgcagccacccgatcatcccgcactttctctgtgacatcctgccagtactgaggctggcaagtgctgggaagcacaggagcgagatctccgtgatgacagccaccatagtcttcattatgatccccttctctctgattgtcacctcttacatccgcatcctgggtgccatcctagcaatggcctccacccagagccgccgcaaggtcttctccacctgctcctcccatctgctcgtggtctctctcttctttggaacagccagcatcacctacatccggccgcaggcaggctcctctgttaccacagaccgcgtcctcagtctcttctacacagtcatcacacccatgctcaaccccatcatctacacccttcggaacaaggacgtgaggagggccctgcgacacttggtgaagaggcagcgcccctcaccctgaagggactcggatgtctgctca

SEQ ID NO: 161981 - DNA, 1037 bp, Homo sapiens
  Payload ID: 11667
  Gene Symbol: OR10Q1
  Gene Name: olfactory receptor, family 10, subfamily Q, member 1
  Uniprot ID: Q8NGQ4
  ENST ID: ENST00000316770
  CDS Start-End: 44-1003
cagccaagaagagctcagcgcgtcctattcttttgcataagacatgcctgtggggaaacttgtcttcaaccagtctgagcccactgagtttgtgttccgtgcgttcaccacagccactgaattccaggttcttctcttccttctcttcctcctcctctacttgatgatcctctgtggcaacacagccatcatctgggtggtgtgcacacacagcaccctccgcaccccgatgtatttcttcctgtccaacctgtctttcctggaactctgctacaccaccgtggtagtacccttgatgctttccaacattttgggggcccagaagcccatttcgttggctggatgtggggcccaaatgttcttctttgtcaccctcggcagcacggactgtttcctcttggcgatcatggcctatgaccgctatgtggctatctgccacccgctgcactacaccctcatcatgacccgcgagctgtgcacgcagatgctgggtggggccctgggcctggccctcttcccctccctgcagctcaccgccttaatcttcaccctgcccttttgcggccaccaccaggaaatcaaccacttcctctgcgatgtgcctcccgtcctgcgcctggcctgcgctgacatccgcgtgcaccaggctgtcctctatgtcgtgagcatcctcgtgctgaccatccccttcctgctcatctgcgtctcctacgtgttcatcacctgtgccatcctgagcatccgttctgccgagggccgccgccgggccttctccacctgctccttccacctcaccgtggtcctgctgcagtatggctgctgcagcctcgtgtacctgcgtcctcggtccagcacctcagaggatgaggacagccaaatcgcgttggtctacacctttgtcacccccttactcaaccctttgctttacagccttaggaacaaggatgtcaaaggtgctctgaggagtgccattatccgtaaagcagcctctgacgccaactgaaggcttaggggcactgggctgggtgtctgtctgt

SEQ ID NO: 161982 - DNA, 1008 bp, Homo sapiens
  Payload ID: 11668
  Gene Symbol: OR10R2
  Gene Name: olfactory receptor, family 10, subfamily R, member 2
  Uniprot ID: Q8NGX6
  ENST ID: ENST00000368152
  CDS Start-End: 1-1008
atgccccaaattcttatattcacatacctgaatatgttttacttctttccccctttgcagatcttggcagaaaacctcaccatggtcaccgaattcctgttgctgggtttttccagccttggtgaaattcagctggccctctttgtagtttttctttttctgtatctagtcattcttagtggcaatgtcaccattatcagtgtcatccacctggataaaagcctccacacaccaatgtacttcttccttggcattctctcaacatctgagaccttctacacctttgtcattctacccaagatgctcatcaatctactttctgtggccaggacaatctccttcaactgttgtgctcttcaaatgttcttcttccttggttttgccattaccaactgcctgctattgggtgtgatgggttatgatcgctatgctgccatttgtcaccctctgcattaccccactcttatgagctggcaggtgtgtggaaaactggcagctgcctgtgcaattggtggcttcttggcctctcttacagtagtaaatttagttttcagcctccctttttgtagcgccaacaaagtcaatcattacttctgtgacatctcagcagtcattcttctggcttgtaccaacacagatgttaacgaatttgtgatattcatttgtggagttcttgtacttgtggttccctttctgtttatctgtgtttcttatctctgcattctgaggactatcctgaagattccctcagctgagggcagacggaaagcgttttccacctgcgcctctcacctcagtgttgttattgttcattatggctgtgcttccttcatctacctgaggcctacagcaaactatgtgtccaacaaagacaggctggtgacggtgacatacacgattgtcactccattactaaaccccatggtttatagcctcagaaacaaggatgtccaacttgctatcagaaaagtgttgggcaagaaaggttctctaaaactatataattga

SEQ ID NO: 161983 - DNA, 1121 bp, Homo sapiens
  Payload ID: 11669
  Gene Symbol: OR10S1
  Gene Name: olfactory receptor, family 10, subfamily S, member 1
  Uniprot ID: Q8NGN2
  ENST ID: ENST00000531945
  CDS Start-End: 91-1086
gaccaaggtggtgtggcttgatggataatgacatctcaggaaagggatacagctatttattccattaatgtcagttttgttgcaaaggggatgactagccgctctgtgtgtgagaagatgaccatgacaacggagaaccccaaccagactgtggtgagccacttcttcctggagggtttgaggtacaccgctaaacattctagcctcttcttcctcctcttcctcctcatctacagcatcactgtggctgggaatctcctcatcctcctaactgtgggctctgactctcacctcagcttacccatgtaccacttcctggggcacctctccttcctggatgcctgtttgtctacagtgacagtgcccaaggtcatggcaggcctgctgactctggatgggaaggtgatctcctttgagggctgtgccgtacagctttattgcttccactttctggccagcactgagtgcttcctgtacacagtcatggcctatgaccgctatctggctatctgtcaacccctgcactacccagtggccatgaacagaaggatgtgtgcagaaatggctggaatcacctgggccataggtgccacgcacgctgcaatccacacctccctcaccttccgcctgctctactgtgggccttgccacattgcctacttcttctgcgacataccccctgtcctaaagctcgcctgtacagacaccaccattaatgagctagtcatgcttgccagcattggcatcgtggctgcaggctgcctcatcctcatcgttatttcctacatcttcatcgtggcagctgtgttgcgcatccgcacagcccagggccggcagcgggccttctccccctgcactgcccagctcactggggtgctcctgtactacgtgccacctgtctgtatctacctgcagcctcgctccagtgaggcaggagctggggcccctgctgtcttctacacaatcgtaactccaatgctcaacccattcatttacactttgcggaacaaggaggtgaagcatgctctgcaaaggcttttgtgcagcagcttccgagagtctacagcaggcagcccacccccatagtctgtgctatcaaaactcacaatttgcctgccagg

SEQ ID NO: 161984 - DNA, 945 bp, Homo sapiens
  Payload ID: 11670
  Gene Symbol: OR10T2
  Gene Name: olfactory receptor, family 10, subfamily T, member 2
  Uniprot ID: Q8NGX3
  ENST ID: ENST00000334438
  CDS Start-End: 1-945
atgcgaggtttcaacaaaaccactgtggttacacagttcatcctggtgggtttctccagcctgggggagctccagctgctgctttttgtcatctttcttctcctatacttgacaatcctggtggccaatgtgaccatcatggccgttattcgcttcagctggactctccacactcccatgtatggctttctattcatcctttcattttctgagtcctgctacacttttgtcatcatccctcagctgctggtccacctgctctcagacaccaagaccatctccttcatggcctgtgccacccagctgttctttttccttggctttgcttgcaccaactgcctcctcattgctgtgatgggatatgatcgctatgtagcaatttgtcaccctctgaggtacacactcatcataaacaaaaggctggggttggagttgatttctctctcaggagccacaggtttctttattgctttggtggccaccaacctcatttgtgacatgcgtttttgtggccccaacagggttaaccactatttctgtgacatggcacctgttatcaagttagcctgcactgacacccatgtgaaagagctggctttatttagcctcagcatcctggtaattatggtgccttttctgttaattctcatatcctatggcttcatagttaacaccatcctgaagatcccctcagctgagggcaagaaggcctttgtcacctgtgcctcacatctcactgtggtctttgtccactatggctgtgcctctatcatctatctgcggcccaagtccaagtctgcctcagacaaggatcagttggtggcagtgacctacacagtggttactcccttacttaatcctcttgtctacagtctgaggaacaaagaggtaaaaactgcattgaaaagagttcttggaatgcctgtggcaaccaagatgagctaa

SEQ ID NO: 161985 - DNA, 1042 bp, Homo sapiens
  Payload ID: 11671
  Gene Symbol: OR10V1
  Gene Name: olfactory receptor, family 10, subfamily V, member 1
  Uniprot ID: Q8NGI7
  ENST ID: ENST00000307552
  CDS Start-End: 20-949
taggtccaatactctactcatggaaggaataaataaaactgcaaagatgcagtttttctttcgtccattctcacctgaccctgaggtccagatgctgatttttgtggtcttcctgatgatgtatctgaccagcctcggtggaaatgctacaattgcagtcattgttcagatcaatcattccctccacacccccatgtactttttcctggctaatctggcagttctagaaatcttctatacatcttccatcaccccattggccttggcaaacctcctttcaatgggcaaaactcctgtttccatcacgggatgtggcacccagatgtttttctttgtcttcttgggtggggctgattgtgtcctgctggtagtcatggcttatgaccagtttatagcgatctgtcaccctctgcgatacaggctcatcatgagctggtccttgtgtgtggagctgctggtaggctccttggtgctggggttcctgttgtcactgccactcaccattttaatcttccatctcccattctgccacaatgatgagatctaccacttctactgtgacatgcctgcagtcatgcgcctggcttgtgcagacacacgcgttcacaagactgctctgtatatcatcagcttcatcgtccttagcatccccctctcattgatctccatctcctatgtcttcatcgtggtagccattttacggatccggtcagcagaagggcgccagcaagcctactctacctgctcttctcacatcttagtggtcctcctgcagtatggctgcaccagctttatatacttgtcccccagttccagctactctcctgagatgggccgggtggtatctgtggcctacacatttatcactcccattttaaaccccttgatctatagtttgaggaacaaggaactgaaagatgccctaaggaaagcattgagaaaattctaggtaggatgatcctatgatttacttaaattgggacacttctgagagtgaaatgggatgctactaataattttgctgaaaggacatgcataggtg

SEQ ID NO: 161986 - DNA, 1469 bp, Homo sapiens
  Payload ID: 11672
  Gene Symbol: OR10W1
  Gene Name: olfactory receptor, family 10, subfamily W, member 1
  Uniprot ID: Q8NGF6
  ENST ID: ENST00000395079
  CDS Start-End: 403-1320
tcccttaccttaatgatttctagccccaagaattccttgacactttcttgtgaatttgctgaaagaattgaattttcattccactctttctgaaaatagctcctgaatcccacccacttcctctgccatttttcttcaatagtatcttacatagtttggcccaactcttggcaggtagaaattgaggtgtagatattaatgtggagaaacttggtaaaagtggagaaaagaaaaagaactagtcttgatccttccagtttctaactccagtgctgattacattagattcatggctcagagtgtaacttaatttatcttcagtctgattcttccttctgtacttgtagctctccacagagaaatactgttagctcaattacctgggaaaatcactcagtgttgatggaatttgtgttcctggcctatccctcctgcccagaactgcatattctgtccttccttggggtcagcctggtttatggtttgatcatcactgggaacattctcattgtggtgtccattcacacagaaacctgtctatgcacatccatgtactatttcctgggcagcctttctgggattgaaatatgctacactgcagtggtggtgccccatatcctggccaacaccctacagtcagagaagaccatcactctcctgggctgtgccacccagatggctttcttcattgcactgggcagtgctgattgcttcctcttggctgccatggcctatgaccgctatgtggccatttgccacccgttgcagtaccctctcctcatgacattgactctttgtgtccacttggttgtggcatcagtcatcagtggtctgttcctgtccttacaactggtggccttcatcttctctctgccattctgccaggctcagggcattgagcacttcttttgtgatgtgccaccagtcatgcatgttgtttgtgctcagagtcacattcatgagcagtcagtgctggtggcagccatactagccattgctgtgcctttcttcctcatcaccacctcctacaccttcatagtggctgctctgctcaagatccactcggctgctggccgccaccgggccttctccacctgctcttcccacctcactgtggtgctgctgcagtatggctgctgtgccttcatgtacctgtgccccagctccagctacaaccccaagcaagatcggttcatctcactggtgtacacattgggaaccccactgctcaacccacttatctatgccctgaggaacagtgagatgaaaggggccgtagggagagttcttaccaggaactgcctttcccagaacagctaggaaagacgaggggacagcctatcaggcaagtatttggttccagcccaccaaatctgtatgaaactgagatttctatcatttggtgttaaaactcatctaaaagatggtataaattatatggatactgtttatgtgtgccaaagattttt

SEQ ID NO: 161987 - DNA, 981 bp, Homo sapiens; identical to SEQ ID NO: 161878
  Payload ID: 11673
  Gene Symbol: OR10X1
  Gene Name: olfactory receptor, family 10, subfamily X, member 1 (gene/pseudogene)
  Uniprot ID: Q8NGY0
  ENST ID: ENST00000368150
  CDS Start-End: 1-981

SEQ ID NO: 161988 - DNA, 942 bp, Homo sapiens
  Payload ID: 11674
  Gene Symbol: OR10Z1
  Gene Name: olfactory receptor, family 10, subfamily Z, member 1
  Uniprot ID: Q8NGY1
  ENST ID: ENST00000361284
  CDS Start-End: 1-942
atggggcagaccaacgtaacctcctggagggattttgtcttcctgggcttctccagttctggggagttgcagctccttctctttgccttgttcctctctctgtatctagtcactctgaccagcaatgtcttcattatcatagccatcaggctggatagccatctgcacacccccatgtacctcttcctttccttcctatccttctctgagacctgctacactttgggcatcatccctagaatgctctctggcctggctgggggggaccaggctatctcctatgtgggctgtgctgcccagatgttcttttctgcctcatgggcctgtactaactgcttccttctggctgccatgggctttgacagatatgtggccatctgtgctccactccactatgccagccacatgaatcctaccctctgtgcccagctggtcattacttccttcctgactggatacctctttggactgggaatgacactagttattttccacctctcattctgcagctcccatgaaatccagcactttttttgtgacacgccacctgtgctgagcctagcctgtggagatacaggcccgagtgagctgaggatctttatcctcagtcttttggtcctcttggtctccttcttcttcatcaccatctcctacgcctacatcttggcagcaatactgaggatcccctctgctgaggggcagaagaaggccttctccacttgtgcctcgcaccttacagtggtcattattcattatggctgtgcttccttcgtgtacctgaggcccaaagccagctactctcttgagagagatcagcttattgccatgacctatactgtagtgacccccctccttaatcccattgtttatagtctaaggaatagggctatacagacagctctgaggaatgctttcagagggagattgctgggtaaaggatga

SEQ ID NO: 161989 - DNA, 2229 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000377147
  CDS Start-End: 92-1039
ctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 161990 - DNA, 2482 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000377148
  CDS Start-End: 345-1292
caactcttaattggccctcaaaacttagcctacttgcttctatcttcagaaagccttccccgaccttgatcccacaccttctgccccacaaccccaggctgggtttggtccttctctgctcccatggcacctacttccttccctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 161991 - DNA, 2611 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000377149
  CDS Start-End: 474-1421
catcctagcagtgaatggaaacacacatatggggagaaactaaggctccctactaaaaacgtgcaacatgtgactgggacatcttgttgagctcaagcagggagggagctgaaggtaggaaattccaacattctgaagtcttcagcaaatcttagcagatcatctcctcctcacagtcctgtctttagagaacagggtcgatatttcgggaatcctatagaaagactccaagcctcagaatgagtttggaccagataaaataatctagagttaaagatggcccacatagggagtgccagattcactcacaaggaaatgcagatgggatcaaaggttaataaacacatattgctttgaatagcatatgaaaaccttccagcagctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 161992 - DNA, 2482 bp, Homo sapiens; identical to SEQ ID NO: 161990
  Payload ID: 11675
  Gene Symbol: OR11A1
  Gene Name: olfactory receptor, family 11, subfamily A, member 1
  Uniprot ID: Q9GZK7
  ENST ID: ENST00000383551
  CDS Start-End: 345-1292

SEQ ID NO: 161993 - DNA, 2482 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000383645
  CDS Start-End: 345-1292
caactcttaattggccctcaaaacttagcctacttgcttctatcttcagaaagccttccccgaccttgatcccacaccttctgccccacaaccccaggctgggtttggtccttctctgctcccatggcacctacttccttccctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 161994 - DNA, 2611 bp, Homo sapiens; identical to SEQ ID NO: 161991
  Payload ID: 11675
  Gene Symbol: OR11A1
  Gene Name: olfactory receptor, family 11, subfamily A, member 1
  Uniprot ID: Q9GZK7
  ENST ID: ENST00000400696
  CDS Start-End: 474-1421

SEQ ID NO: 161995 - DNA, 2611 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000400715
  CDS Start-End: 474-1421
catcctagcagtgaatggaaacacacatatggggagaaactaaggctccctactaaaaacgtgcaacatgtgactgggacatcttgttgagctcaagcagggagggagctgaaggtaggaaattccaacattctgaagtcttcagcaaatcttagcagatcatctcctcctcacagtcctgtctttagagaacagggtcgatatttcgggaatcctatagaaagactccaagcctcagaatgagtttggaccagataaaataatctagagttaaagatggcccacatagggagtgccagattcactcacaaggaaatgcagatgggatcaaaggttaataaacacatattgctttgaatagcatatgaaaaccttccagcagctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 161996 - DNA, 2482 bp, Homo sapiens; identical to SEQ ID NO: 161993
  Payload ID: 11675
  Gene Symbol: OR11A1
  Gene Name: olfactory receptor, family 11, subfamily A, member 1
  Uniprot ID: Q9GZK7
  ENST ID: ENST00000440485
  CDS Start-End: 345-1292

SEQ ID NO: 161997 - DNA, 2611 bp, Homo sapiens; identical to SEQ ID NO: 161995
  Payload ID: 11675
  Gene Symbol: OR11A1
  Gene Name: olfactory receptor, family 11, subfamily A, member 1
  Uniprot ID: Q9GZK7
  ENST ID: ENST00000435232
  CDS Start-End: 474-1421

SEQ ID NO: 161998 - DNA, 2611 bp, Homo sapiens; identical to SEQ ID NO: 161995
  Payload ID: 11675
  Gene Symbol: OR11A1
  Gene Name: olfactory receptor, family 11, subfamily A, member 1
  Uniprot ID: Q9GZK7
  ENST ID: ENST00000419773
  CDS Start-End: 474-1421

SEQ ID NO: 161999 - DNA, 2611 bp, Homo sapiens; identical to SEQ ID NO: 161995
  Payload ID: 11675
  Gene Symbol: OR11A1
  Gene Name: olfactory receptor, family 11, subfamily A, member 1
  Uniprot ID: Q9GZK7
  ENST ID: ENST00000428144
  CDS Start-End: 474-1421

SEQ ID NO: 162000 - DNA, 2482 bp, Homo sapiens; identical to SEQ ID NO: 161993
  Payload ID: 11675
  Gene Symbol: OR11A1
  Gene Name: olfactory receptor, family 11, subfamily A, member 1
  Uniprot ID: Q9GZK7
  ENST ID: ENST00000421634
  CDS Start-End: 345-1292

SEQ ID NO: 162001 - DNA, 2482 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000418485
  CDS Start-End: 345-1292
caactcttaattggccctcaaaacttagcctacttgcttctatcttcagaaagccttccccgaccttgatcccacaccttctgccccacaaccccaggctgggtttggtccttctctgctcccatggcacctacttccttcgctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 162002 - DNA, 2482 bp, Homo sapiens; identical to SEQ ID NO: 161993
  Payload ID: 11675
  Gene Symbol: OR11A1
  Gene Name: olfactory receptor, family 11, subfamily A, member 1
  Uniprot ID: Q9GZK7
  ENST ID: ENST00000427264
  CDS Start-End: 345-1292

SEQ ID NO: 162003 - DNA, 2611 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000418560
  CDS Start-End: 474-1421
catcctagcagtgaatggaaacacacatatggggagaaactaaggctccctactaaaaacgtgcaacatgtgactgggacatcttgttgagctcaagcagggagggagctgaaggtaggaaattccaacattctgaagtcttcagcaaatcttagcagatcatctcctcctcacagtcctgtctttagagaacagggtcgatatttcgggaatcctatagaaagactccaagcctcagaatgagtttggaccagataaaataatctagagttaaagatggcccacatagggagtgccagattcactcacaaggaaatgcagatgggatcaaaggttaataaacacatattgctttgaatagcatatgaaaaccttccagcagctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtgacccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 162004 - DNA, 2482 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000411967
  CDS Start-End: 345-1292
caactcttaattggccctcaaaacttagcctacttgcttctatcttcagaaagccttccccgaccttgatcccacaccttctgccccacaaccccaggctgggtttggtccttctctgctcccatggcacctacttccttccctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtgacccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 162005 - DNA, 2611 bp, Homo sapiens; identical to SEQ ID NO: 161995
  Payload ID: 11675
  Gene Symbol: OR11A1
  Gene Name: olfactory receptor, family 11, subfamily A, member 1
  Uniprot ID: Q9GZK7
  ENST ID: ENST00000444884
  CDS Start-End: 474-1421

SEQ ID NO: 162006 - DNA, 2229 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000547506
  CDS Start-End: 92-1039
ctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 162007 - DNA, 2229 bp, Homo sapiens; identical to SEQ ID NO: 162006
  Payload ID: 11675
  Gene Symbol: OR11A1
  Gene Name: olfactory receptor, family 11, subfamily A, member 1
  Uniprot ID: Q9GZK7
  ENST ID: ENST00000552225
  CDS Start-End: 92-1039

SEQ ID NO: 162008 - DNA, 2229 bp, Homo sapiens
  Payload ID: 11675
  Gene Symbol: OR11A1
  Gene Name: olfactory receptor, family 11, subfamily A, member 1
  Uniprot ID: Q9GZK7
  ENST ID: ENST00000548813
  CDS Start-End: 92-1039
ctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtgacccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 162009 - DNA, 2229 bp, Homo sapiens; identical to SEQ ID NO: 162006
  Payload ID: 11675
  Gene Symbol: OR11A1
  Gene Name: olfactory receptor, family 11, subfamily A, member 1
  Uniprot ID: Q9GZK7
  ENST ID: ENST00000551986
  CDS Start-End: 92-1039

SEQ ID NO: 162010 - DNA, 2229 bp, Homo sapiens; identical to SEQ ID NO: 162006
  Payload ID: 11675
  Gene Symbol: OR11A1
  Gene Name: olfactory receptor, family 11, subfamily A, member 1
  Uniprot ID: Q9GZK7
  ENST ID: ENST00000549749
  CDS Start-End: 92-1039

SEQ ID NO: 162011 - DNA, 2229 bp, Homo sapiens; identical to SEQ ID NO: 161989
  Payload ID: 11675
  Gene Symbol: OR11A1
  Gene Name: olfactory receptor, family 11, subfamily A, member 1
  Uniprot ID: Q9GZK7
  ENST ID: ENST00000546665
  CDS Start-End: 92-1039

SEQ ID NO: 162012 - DNA, 2229 bp, Homo sapiens; identical to SEQ ID NO: 162006
  Payload ID: 11675
  Gene Symbol: OR11A1
  Gene Name: olfactory receptor, family 11, subfamily A, member 1
  Uniprot ID: Q9GZK7
  ENST ID: ENST00000547645
  CDS Start-End: 92-1039

SEQ ID NO: 162013 - DNA, 1111 bp, Homo sapiens
  Payload ID: 11676
  Gene Symbol: OR11G2
  Gene Name: olfactory receptor, family 11, subfamily G, member 2
  Uniprot ID: Q8NGC1
  ENST ID: ENST00000357366
  CDS Start-End: 1-1038
atgcattttctttcccaaaatgatttaaatataaatctgattccccatctatgtttgcaccgtcattcagtaattgctggtgcttttacaattcacaggcacatgaaaatcttcaacagccccagcaactccagcaccttcactggcttcatcctcctgggcttcccttgccccagggaggggcagatcctcctctttgtgctcttcactgttgtttacctcctgaccctcatgggcaatggttccatcatctgtgctgtgcactgggatcagagactccacgcccccatgtacatcctgctcgccaacttctccttcttggagatatgttatgtcacctccacagtccccagcatgctggccaacttcctctctgacaccaagatcatctcgttctctggctgcttcctccagttctactttttcttctccttgggctctacagaatgctttttcctggcagttatggcatttgatcgataccttgccatctgtcggcctctacgctatccaaccattatgaccagacgtctctgtaccaatcttgtggtcaattgctgggtacttggtttcatctggttcttgattcctatcgtcaacatctcccaaatgtccttctgtggatctaggattattgaccacttcctatgtgacccagctcctcttctaactctcacttgcaaaaaaggccctgtgatagagcttgtcttttctgtcttaagtcctctgcctgtctttatgctctttctcttcattgtggggtcctatgctctggtcgtgagagctgtgttgagggtcccttcagcagctgggagaagaaaggctttctccacctgtgggtctcacctggctgtggtttcactgttctacggctcagtactggtcatgtatgggagcccaccatctaagaatgaagctggaaagcagaagactgtgactctgttttattctgttgttaccccactgcttaaccctgtgatatatagtcttaggaacaaagatatgagaaaagctctgaagaaattttggggaacataaaatgttaatcaaaaaggtccttgcgtaattaatcttgtctttaattttggggtttaaaaaaaaaactggtctt

SEQ ID NO: 162014 - DNA, 982 bp, Homo sapiens
  Payload ID: 11677
  Gene Symbol: OR11H1
  Gene Name: olfactory receptor, family 11, subfamily H, member 1
  Uniprot ID: Q8NG94
  ENST ID: ENST00000252835
  CDS Start-End: 2-982
aatgtgtcccttgaccttgcaggtcactggcctaatgaatgtctctgagccaaattccagctttgcttttgtaaatgaatttatactccaaggtttctcttgtgagtggacaattcagatcttcctcttctcactctttactacaacatatgcactgactataacagggaatggagccattgcttttgtcctgtggtgtgaccggcgacttcacactcccatgtacatgttcctgggaaatttctcctttttagagatatggtatgtctcttctacagttcccaagatgttggtcaacttcctttcagagaaaaaaaacatctcctttgctggatgttttctccagttttatttcttcttctctttgggtacatcagaatgcttgcttttgactgtgatggcctttgatcagtaccttgctatctgccgtcccttgctctatcctaatatcatgactgggcatctctatgccaaactggtcatactgtgctgggtttgtggatttctgtggttcctgatccccattgttctcatctctcagatgcccttctgtggcccaaacattattgaccatgttgtgtgtgacccagggccacgatttgcattggattgtgtttctgccccaagaatccaactgttttgctacactctaagctcattagttatttttggtaacttcctctttattattggatcctatactcttgtcctgaaagctatgttgggtatgccttcaagcactgggagacataaggccttctctacctgtgggtctcatttggctgtggtatcactgtgctatagctctcttatggtcatgtatgtgagcccaggactcggacattctacagggatgcagaaaattgaaactttgttctatgctatggtgaccccactcttcaatccccttatctatagcctccagaataaggagataaaggcagccctgaggaaagttctggggagttccaacataatctaa

SEQ ID NO: 162015 - DNA, 1085 bp, Homo sapiens
  Payload ID: 11678
  Gene Symbol: OR11H12
  Gene Name: olfactory receptor, family 11, subfamily H, member 12
  Uniprot ID: B2RN74
  ENST ID: ENST00000550708
  CDS Start-End: 73-1053
tgacttcatgttcattatcttctcttcattcttaaaaaaggaacacattttataaaagagtcctgactgataatgtgtcccttgaccttgcaggtcactggcctaatgaatgtctctgagccaaattccagctttgcttttgtaaatgaatttatactccaaggtttcacttgtgagtggacaattcagatcttcctcttctcactctttactacaacatatgcactgactataacagggaatggagccattgcttttgtcctgtggtgtgactggcgacttcacactcccatgtacatgttcctgggaaatttctcctttttagagatatggtatgtctcttctacagttcccaagatgttggtcaacttcctttcagagaaaaaaaacatctcctttgctggatgttttctccagttttatttcttcttctctttgggtacatcagaatgcttgcttttgactgtgatggcctttgatcagtaccttgctatctgccgtcccttgctctatcctaatatcatgactgggcatctctgtgccaaactggtcatactgtgctgggtttgtggatttctgtggttcctgatccccattgttctcatctctcagatgcccttctgtggcccaaacattattgaccatgttgtgtgtgacccagggccacgatttgcattggattgtgtttctgccccaagaatccaactgttttgctacactctaagctcattagttatttttggtaacttcctctttattattggatcctatactcttgtcctgaaagctgtgttgggtatgccttcaagcactgggagacataaggccttctctacctgtgggtctcatttggctgtggtatcactgtgctatagctctcttatggtcatgtatgtgagcccaggactcggacattctacagggatgcagaaaattgaaactttgttctatgctatggtgaccccactcttcaatccccttatctatagcctccagaataaggagataaaggcagccctgaggaaagttctgggaagttccaacataatctaaggcatattagattattcctccatgatcagatc

SEQ ID NO: 162016 - DNA, 985 bp, Homo sapiens
  Payload ID: 11679
  Gene Symbol: OR11H2
  Gene Name: olfactory receptor, family 11, subfamily H, member 2
  Uniprot ID: Q8NH07
  ENST ID: ENST00000556246
  CDS Start-End: 5-985
gataatgtgtcccttgaccttgcatgtcactggcctaatgaatgtctctgagccaaattccagctttgcttttgtaaatgaatttatactccaaggtttctcttgtgagtggacaattcagatcttcctcttctcactctttactacaatatatgcactgactataacagggaatggagccattgcttttgtcctgtggtgtgaccggcgacttcacactcccatgtacatgttcctgggaaatttctcctttttagagatatggtatgtctcttctacagttcccaagatgttggtcaacttcctttcagagaaaaaaaacatctcctttgctggatgttttctccagttttatttcttcttctctttgggtacatcagaatgcttgcttttgactgtgatggcctttgatcagtaccttgctatctgccgtcccttgctctatcctaatatcatgactgggcatctctatgccaaactggtcatactgtgctgggtttgtggatttctgtggttcctgatccccattgttctcatctctcagaagcccttctgtggcccaaacattattgaccatgttgtgtgtgacccagggccactatttgcattggattgtgtttctgccccaagaatccaactgttttgctacactctaagctcattagttatttttggtaacttcctctttattattggatcctatactcttgtcctgaaagctgtgttgggtatgccttcaagcactgggagacataaggccttctctacctgtgggtctcatttggctgtggtatcactgtgctatagccctcttatggtcatgtatgtgagcccaggactcggacattctacagggatgcagaaaattgaaactttgttctatgctatggtgaccccactcttcaatccccttatctatagcctccagaataaggagataaaggcagccctgaggaaagttctggggagttccaacataatctaa

SEQ ID NO: 162017 - DNA, 1082 bp, Homo sapiens
  Payload ID: 11680
  Gene Symbol: OR11H4
  Gene Name: olfactory receptor, family 11, subfamily H, member 4
  Uniprot ID: Q8NGC9
  ENST ID: ENST00000315409
  CDS Start-End: 54-1028
tgagatacgtagcaagcaattggattacactccaagagacttggattacactcatgtctttcttctttgtagacttaagacccatgaacaggtcagcaacacacatcgtgacagagtttattctcctgggattccctggttgctggaagattcagattttcctcttctcattgtttttggtgatttatgtcttgaccttgctgggaaatggagccatcatctatgcagtgagatgcaacccactactacacacccccatgtactttctgctgggaaattttgccttccttgagatctggtatgtgtcctccactattcctaacatgctagtcaacattctctccaagaccaaggccatctcattttctgggtgcttcctccagttctatttcttcttttcactgggaacaactgaatgtctctttctggcagtaatggcttatgatcgatacctggccatctgccacccactgcagtaccctgccatcatgactgtaaggttctgtggtaagctggtgtctttctgttggcttattggattccttggatacccaattcccattttctacatctcccaactccccttctgtggtcctaatatcattgatcacttcctgtgtgacatggacccattgatggctctatcctgtgccccagctcccataactgaatgtattttctatactcagagctcccttgtcctctttttcactagtatgtacattcttcgatcctatatcctgttactaacagctgtttttcaggtcccttctgcagctggtcggagaaaagccttctctacctgtggttctcatttggttgtggtatctcttttctatgggacagtcatggtaatgtatgtaagtcctacatatgggatcccaactttattgcagaagatcctcacactggtatattcagtaacgactcctctttttaatcctctgatctatactcttcgtaataaggacatgaaactcgctctgagaaatgtcctgtttggaatgagaattcgtcaaaattcgtgagccaaagatgtgccatacttacaagttctaacgaagaacaaggtcgagatgttg

SEQ ID NO: 162018 - DNA, 1174 bp, Homo sapiens
  Payload ID: 11681
  Gene Symbol: OR11H6
  Gene Name: olfactory receptor, family 11, subfamily H, member 6
  Uniprot ID: Q8NGC7
  ENST ID: ENST00000315519
  CDS Start-End: 79-1071
tcattaggaagaccaaatgagataatgtatgtaaaaatacttagtacatcatccagcatgagttagcaaaatctccaaatgttctttattattcattctttggttacttctgtttttctaacagctttgggaccccagaacagaacaatgcattttgtgactgagtttgtcctcctgggtttccatggtcaaagggagatgcagagctgcttcttctcattcatcctggttctctatctcctgacactgctagggaatggagctattgtctgtgcagtgaaattggacaggcggctccacacacccatgtacatccttctgggaaactttgcctttctagagatctggtacatttcctccactgtcccaaacatgctagtcaatatcctctctgagattaaaaccatctccttctctggttgcttcctgcaattctatttctttttttcactgggtacaacagagtgtttctttttatcagttatggcttatgatcggtacctggccatctgtcgtccattacactacccctccatcatgactgggaagttctgtataattctggtctgtgtatgctgggtaggcggatttctctgctatccagtccctattgttcttatctcccaacttcccttctgtgggcccaacatcattgaccacttggtgtgtgacccaggcccattgtttgcactggcctgcatctctgctccttccactgagcttatctgttacaccttcaactcgatgattatctttgggcccttcctctccatcttgggatcttacactctggtcatcagagctgtgctttgtattccctctggtgctggtcgaactaaagctttctccacatgtgggtcccacctaatggtggtgtctctattctatggaacccttatggtgatgtatgtgagcccaacatcagggaacccagcaggaatgcagaagatcatcactctggtatacacagcaatgactccattcttaaatccccttatctatagtcttcgaaacaaagacatgaaagatgctctaaagagagtcctggggttaacagttagccaaaactgagatatctttgaaaaagaagccaaattggccacttctgaccttaattttttataactatagagagtagcttcagtagtatgttctggctcacactcaggtagac

SEQ ID NO: 162019 - DNA, 940 bp, Homo sapiens
  Payload ID: 11682
  Gene Symbol: OR11H7
  Gene Name: olfactory receptor, family 11, subfamily H, member 7 (gene/pseudogene)
  ENST ID: ENST00000553765
  CDS Start-End: 1-940
atgaataactcacagatatctactgtgacgcagtttgtgttgttggggtttcctggtccctggaaaattcagatcatctttttctcaatgattttgttggtctacatcttcactctgactgggaatatggccatcatctgtgcagtgaggtgggaccatcgactccatacccctatgtacgtgctcctagccaacttctccttcctagagatctggtatgtgacctgcacagtccccaacatgctggtaaattttttctccaaaactaagaccatatcattctctggatgtttcactcagttccacttcttcttttccctgggcacaactgaatgcttcttcctctgtgtcatggcttatgatcggtacctggccatctgccacccactgcactatccctccattatgactggccagctctgtggcatcttggtgtctctttgttggctcattggtttccttggacattcaatttccattttcttcatttttcaactacctttctgtggtcccaacatcattgatcattttctgtgtgatgtagacccactgatggcattgtcctctgcccctactcacatcatagggcatgtgttccattctgtgagctctcttttcatcaacctcaccatggtgtacatccttgggtcctataccttggtgctcagaactgtgctttaggttccttcttcagctggatggcaaaaggccatctctacctgtgggtcacacttggttgttgtgtctctgttctatggagccataatgctgatgtatgtgagtcccacacctggcaactcagttgctatgcataagctcatcacactgatatattctgtggtaacacctgtcttaaaccccctcatctacagcctacgcaacaaggacatgaaatatgccctccatcatgtcttctgtggaatgagaattatccagagat

SEQ ID NO: 162020 - DNA, 969 bp, Homo sapiens
  Payload ID: 11683
  Gene Symbol: OR11L1
  Gene Name: olfactory receptor, family 11, subfamily L, member 1
  Uniprot ID: Q8NGX0
  ENST ID: ENST00000355784
  CDS Start-End: 1-969
atggagccccaaaatacctccactgtgactaactttcagctgttaggattccagaaccttcttgaatggcaggccctgctctttgtcattttcctgctcatctactgcctgaccattatagggaatgttgtcatcatcaccgtggtgagccagggcctgcgactgcactcccctatgtacatgttcctccagcatctctcctttctggaggtctggtacacgtccaccactgtgccccttctcctagccaacctgctgtcctggggccaagccatctccttctctgcctgcatggcacagctctacttcttcgtattcctcggcgccaccgagtgctttctcctggccttcatggcctatgaccgttacctggccatctgcagcccactccgctaccccttcctcatgcatcgtgggctctgtgccaggttggtggtggtctcctggtgcacaggggtcagcacaggctttctgccttccctgatgatttccaggttggacttctgtgggcgcaatcagattaaccatttcttctgcgacctcccgccactcatgcagctctcctgttccagagtttatatcaccgaggtgaccatcttcatcctgtcaattgccgtgctgtgcatttgtttttttctgacactggggccctatgttttcattgtgtcctccatattgagaatcccttccacctctggccggagaaagaccttttccacatgtggctcccacctggctgttgtcactctctactacgggaccatgatctccatgtatgtgtgtcccagtccccacctgttgcctgaaatcaacaagatcatttctgtcttctacactgtggtcacaccactgctgaacccagttatctacagcttgaggaacaaagacttcaaagaagctgttagaaaggtcatgagaaggaaatgtggtattctatggagtacaagtaaaaggaagttcctttattag

SEQ ID NO: 162021 - DNA, 947 bp, Homo sapiens
  Payload ID: 11684
  Gene Symbol: OR12D1
  Gene Name: olfactory receptor, family 12, subfamily D, member 1 (gene/pseudogene)
  ENST ID: ENST00000514827
  CDS Start-End: 1-947
atgctgaatacaacctcagtcactgaatttctccttttgggagtgacagacattcaagaactgcagccttttctcttcgttgttttccttaccatctacttcatcagtgtggctgggaatggagccattctgatgattgtcatctctgatcctagactccattcccctatgtatttcttcttgggaaacctgtcctgcctggacatctgctactccagcgtaacactgccaaaaatgctgcagaacttcctctctgcacacaaagcaatttctttcttgggatgcataagccaactccatttcttccacttcctgggcagcacagaggccatgttgttggccgtgatggcatttgaccgctttgtggctatttgcaagccacttcgctacactgtcattatgaaccctcagctctgtacccagatggccatcacaatctggatgattggttttttccatgccctgctgcactccctaatgacctctcgcttgaacttctgtggttctaaccgtatctatcacttcttctgtgatgtgaagccattgctaaagctgagcttaatcagtggctgctcagtactgtcacagggacaatcgccatgggccccttctttctcacattactctcctatttctacattatcacccatctcttcttcaagactcattcttttagcatgctccgcaaagcactgtccacttgtgcctcccacttgatggtagttattcttttgtatgcacctgttctcttcacctatattcatcatgcctcagggacctccatggaccaggaccggatcactgccatcatgtatactgtggtcactccagtactaaacccactgatctacactttgaggaacaaggaagtgaaaggggcctttaatagagcaatgaaaaggtggctttggcctaaagaaatcttgaagaactcttctgaagcataa

SEQ ID NO: 162022 - DNA, 1069 bp, Homo sapiens
  Payload ID: 11685
  Gene Symbol: OR12D2
  Gene Name: olfactory receptor, family 12, subfamily D, member 2 (gene/pseudogene)
  Uniprot ID: P58182
  ENST ID: ENST00000377140
  CDS Start-End: 146-1069
agcttctatacaacttctgaggtttggaagaagtacaacagtactctccttccaagtatctttggcttggtgagaaaattctgagccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttga

SEQ ID NO: 162023 - DNA, 924 bp, Homo sapiens
  Payload ID: 11685
  Gene Symbol: OR12D2
  Gene Name: olfactory receptor, family 12, subfamily D, member 2 (gene/pseudogene)
  Uniprot ID: P58182
  ENST ID: ENST00000383555
  CDS Start-End: 1-924
atgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccactccctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttga

SEQ ID NO: 162024 - DNA, 1069 bp, Homo sapiens
  Payload ID: 11685
  Gene Symbol: OR12D2
  Gene Name: olfactory receptor, family 12, subfamily D, member 2 (gene/pseudogene)
  ENST ID: ENST00000432767
  CDS Start-End: 146-1069
agcttctatacaacttctgaggtttggaagaagtacaacagtactctccttccaagtatctttggcttggtgagaaaattctgagccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattttcatctccgatcctagactccattcccctatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttggccgtgatggcatttgaccgctctgtggctatctgcaagccacttcgctacactgtcatcatgaaccctcagctctgtacccagatggccatcacaatctgggtcattggttttttccatgccctgctgcactccataatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttctcttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttga

SEQ ID NO: 162025 - DNA, 1069 bp, Homo sapiens
  Payload ID: 11685
  Gene Symbol: OR12D2
  Gene Name: olfactory receptor, family 12, subfamily D, member 2 (gene/pseudogene)
  ENST ID: ENST00000443442
  CDS Start-End: 146-1069
agcttctatacaacttctgaggtttggaagaagtacaacagtactctccttccaagtatctttggcttggtgagaaaattctgagccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattttcatctccgatcctagactccattcccctatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttggccgtgatggcatttgaccgctgtgtggctatctgcaagccacttcgctacactgtcatcatgaaccctcagctctgtacccagatggccatcacaatctgggtcattggttttttccatgccctgctgcactccataatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttctcttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttga

SEQ ID NO: 162026 - DNA, 1069 bp, Homo sapiens; identical to SEQ ID NO: 162022
  Payload ID: 11685
  Gene Symbol: OR12D2
  Gene Name: olfactory receptor, family 12, subfamily D, member 2 (gene/pseudogene)
  Uniprot ID: P58182
  ENST ID: ENST00000414415
  CDS Start-End: 146-1069

SEQ ID NO: 162027 - DNA, 1069 bp, Homo sapiens; identical to SEQ ID NO: 162022
  Payload ID: 11685
  Gene Symbol: OR12D2
  Gene Name: olfactory receptor, family 12, subfamily D, member 2 (gene/pseudogene)
  Uniprot ID: P58182
  ENST ID: ENST00000438569
  CDS Start-End: 146-1069

SEQ ID NO: 162028 - DNA, 1033 bp, Homo sapiens
  Payload ID: 11685
  Gene Symbol: OR12D2
  Gene Name: olfactory receptor, family 12, subfamily D, member 2 (gene/pseudogene)
  Uniprot ID: P58182
  ENST ID: ENST00000623508
  CDS Start-End: 62-985
gccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccactccctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttgatttgaataaaccagagaactctactgaggcataaataaccagcaatga

SEQ ID NO: 162029 - DNA, 1069 bp, Homo sapiens
  Payload ID: 11685
  Gene Symbol: OR12D2
  Gene Name: olfactory receptor, family 12, subfamily D, member 2 (gene/pseudogene)
  Uniprot ID: P58182
  ENST ID: ENST00000623183
  CDS Start-End: 146-1069
agcttctatacaacttctgaggtttggaagaagtacaacagtactctccttccaagtatctttggcttggtgagaaaattctgagccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccactccctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttga

SEQ ID NO: 162030 - DNA, 2011 bp, Homo sapiens
  Payload ID: 11686
  Gene Symbol: OR12D3
  Gene Name: olfactory receptor, family 12, subfamily D, member 3
  Uniprot ID: Q9UGF7
  ENST ID: ENST00000383556
  CDS Start-End: 147-1097
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcagcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatgtcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 162031 - DNA, 1869 bp, Homo sapiens
  Payload ID: 11686
  Gene Symbol: OR12D3
  Gene Name: olfactory receptor, family 12, subfamily D, member 3
  Uniprot ID: Q9UGF7
  ENST ID: ENST00000396806
  CDS Start-End: 5-955
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaaagtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 162032 - DNA, 2011 bp, Homo sapiens
  Payload ID: 11686
  Gene Symbol: OR12D3
  Gene Name: olfactory receptor, family 12, subfamily D, member 3
  Uniprot ID: Q9UGF7
  ENST ID: ENST00000430148
  CDS Start-End: 147-1097
aaactgtgctgccacaggcccatttttcggtgagaaagctagaaaagttggaggacttgttctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgcttgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtacacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 162033 - DNA, 2011 bp, Homo sapiens
  Payload ID: 11686
  Gene Symbol: OR12D3
  Gene Name: olfactory receptor, family 12, subfamily D, member 3
  Uniprot ID: Q9UGF7
  ENST ID: ENST00000505384
  CDS Start-End: 147-1097
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgcttgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtacacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 162034 - DNA, 2011 bp, Homo sapiens
  Payload ID: 11686
  Gene Symbol: OR12D3
  Gene Name: olfactory receptor, family 12, subfamily D, member 3
  ENST ID: ENST00000502578
  CDS Start-End: 147-1097
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 162035 - DNA, 2011 bp, Homo sapiens
  Payload ID: 11686
  Gene Symbol: OR12D3
  Gene Name: olfactory receptor, family 12, subfamily D, member 3
  ENST ID: ENST00000508665
  CDS Start-End: 147-1097
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 162036 - DNA, 1869 bp, Homo sapiens
  Payload ID: 11686
  Gene Symbol: OR12D3
  Gene Name: olfactory receptor, family 12, subfamily D, member 3
  ENST ID: ENST00000551240
  CDS Start-End: 5-955
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 162037 - DNA, 1869 bp, Homo sapiens
  Payload ID: 11686
  Gene Symbol: OR12D3
  Gene Name: olfactory receptor, family 12, subfamily D, member 3
  Uniprot ID: Q9UGF7
  ENST ID: ENST00000552446
  CDS Start-End: 5-955
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgcttgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtacacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 162038 - DNA, 1869 bp, Homo sapiens; identical to SEQ ID NO: 162037
  Payload ID: 11686
  Gene Symbol: OR12D3
  Gene Name: olfactory receptor, family 12, subfamily D, member 3
  Uniprot ID: Q9UGF7
  ENST ID: ENST00000550913
  CDS Start-End: 5-955

SEQ ID NO: 162039 - DNA, 1869 bp, Homo sapiens
  Payload ID: 11686
  Gene Symbol: OR12D3
  Gene Name: olfactory receptor, family 12, subfamily D, member 3
  ENST ID: ENST00000552012
  CDS Start-End: 5-955
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 162040 - DNA, 1869 bp, Homo sapiens
  Payload ID: 11686
  Gene Symbol: OR12D3
  Gene Name: olfactory receptor, family 12, subfamily D, member 3
  Uniprot ID: Q9UGF7
  ENST ID: ENST00000550681
  CDS Start-End: 5-955
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcagcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatgtcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 162041 - DNA, 1177 bp, Homo sapiens
  Payload ID: 11687
  Gene Symbol: OR13A1
  Gene Name: olfactory receptor, family 13, subfamily A, member 1
  Uniprot ID: Q8NGR1
  ENST ID: ENST00000374401
  CDS Start-End: 113-1099
tgtcctcctgtccccacccaatcacaataagtggtgatgtgaggtgtggaagaaacacgggagcagccttcctcaggacacctcttgtttatctctctagctctgaaatcacatgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaacttgtgtcttctgaagtttttgtccttggagactgcagttttagtggagtctgatgagcaagtttctggactgggagg

SEQ ID NO: 162042 - DNA, 2023 bp, Homo sapiens
  Payload ID: 11687
  Gene Symbol: OR13A1
  Gene Name: olfactory receptor, family 13, subfamily A, member 1
  Uniprot ID: Q8NGR1
  ENST ID: ENST00000536058
  CDS Start-End: 255-1241
taatccaagatgccttttttcccccttcagaagcttgagtgcccaagggtttgataaatgtggaaaataaccgctgttcgaatatcctgttggcctgctgaagaaatgactggctgaggctgtaaagaaatcttgtggtcattctcatggaaagaggattggagccccgattctttgatctcattattgaccagttgattgagaagactgtcctcctgtccccacccaatcacaataagtggctctgaaatcacatgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaacttgtgtcttctgaagtttttgtccttggagactgcagttttagtggagtctgatgagcaagtttctggactgggaggtaaatagacttgttttttctaacccagcagaacctgtgcatggatgagctgggagtgctggttccctgagacttggtgatggggggattgcggtaggtgtgacccaccagcctctgagacaccagatctcttggtctgactccaaggtggtgtcagtgctgagttggcagagaaacacagggcctaggaggagaaaagtgttccttgtgttttcaactcatagccacatcaaacattttccttttgtatgtacaacactcagggtgtaaattctaaaatcacacctagaattcagctgtgtgggtctaaaaagttaggcagaattgtggaccccacagcccctgaagggttgtcagactgaagctttgttttaaggtgaccactggcctctaggaaaccttctacccccattatcttacctcaactgtttcctctggagccacttggacttcaaaaatagtttgattttaatgcaaactgttgtttctgcttttgtcttttcttcttactaacacttcagattctgagtatctgacctacctaattggcctggagcgaggacagctgccatgagtcagctctaataagttaaacggcattgtagtaaggcattgctatccttccattgtttcagataaaactgggtgaacgaatcctctgtgtctaataaagacaggtcttgtgcttgtgctccatgctattac

SEQ ID NO: 162043 - DNA, 2078 bp, Homo sapiens
  Payload ID: 11687
  Gene Symbol: OR13A1
  Gene Name: olfactory receptor, family 13, subfamily A, member 1
  Uniprot ID: Q8NGR1
  ENST ID: ENST00000553795
  CDS Start-End: 310-1296
actatattgaatagaagcgaagagacagagtatacttgtcttgttcctaatccagaagaaaagtttgaatcttttaccattgagtaagcttgagtgcccaagggtttgataaatgtggaaaataaccgctgttcgaatatcctgttggcctgctgaagaaatgactggctgaggctgtaaagaaatcttgtggtcattctcatggaaagaggattggagccccgattctttgatctcattattgaccagttgattgagaagactgtcctcctgtccccacccaatcacaataagtggctctgaaatcacatgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaacttgtgtcttctgaagtttttgtccttggagactgcagttttagtggagtctgatgagcaagtttctggactgggaggtaaatagacttgttttttctaacccagcagaacctgtgcatggatgagctgggagtgctggttccctgagacttggtgatggggggattgcggtaggtgtgacccaccagcctctgagacaccagatctcttggtctgactccaaggtggtgtcagtgctgagttggcagagaaacacagggcctaggaggagaaaagtgttccttgtgttttcaactcatagccacatcaaacattttccttttgtatgtacaacactcagggtgtaaattctaaaatcacacctagaattcagctgtgtgggtctaaaaagttaggcagaattgtggaccccacagcccctgaagggttgtcagactgaagctttgttttaaggtgaccactggcctctaggaaaccttctacccccattatcttacctcaactgtttcctctggagccacttggacttcaaaaatagtttgattttaatgcaaactgttgtttctgcttttgtcttttcttcttactaacacttcagattctgagtatctgacctacctaattggcctggagcgaggacagctgccatgagtcagctctaataagttaaacggcattgtagtaaggcattgctatccttccattgtttcagataaaactgggtgaacgaatcctctgtgtctaataaagacaggtcttgtgcttgtgctccatgctattac

SEQ ID NO: 162044 - DNA, 1177 bp, Homo sapiens; identical to SEQ ID NO: 162041
  Payload ID: 11687
  Gene Symbol: OR13A1
  Gene Name: olfactory receptor, family 13, subfamily A, member 1
  Uniprot ID: Q8NGR1
  ENST ID: ENST00000615770
  CDS Start-End: 113-1099

SEQ ID NO: 162045 - DNA, 2078 bp, Homo sapiens; identical to SEQ ID NO: 162043
  Payload ID: 11687
  Gene Symbol: OR13A1
  Gene Name: olfactory receptor, family 13, subfamily A, member 1
  Uniprot ID: Q8NGR1
  ENST ID: ENST00000616267
  CDS Start-End: 310-1296

SEQ ID NO: 162046 - DNA, 2023 bp, Homo sapiens; identical to SEQ ID NO: 162042
  Payload ID: 11687
  Gene Symbol: OR13A1
  Gene Name: olfactory receptor, family 13, subfamily A, member 1
  Uniprot ID: Q8NGR1
  ENST ID: ENST00000612185
  CDS Start-End: 255-1241

SEQ ID NO: 162047 - DNA, 957 bp, Homo sapiens
  Payload ID: 11688
  Gene Symbol: OR13C2
  Gene Name: olfactory receptor, family 13, subfamily C, member 2
  Uniprot ID: Q8NGS9
  ENST ID: ENST00000542196
  CDS Start-End: 1-957
atggaatgggaaaaccacaccattctggtggaattttttctgaagggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcggcttggccatggggacaacagagtgtgtgcttctgggcatgatggcctttgaccgctatgtggctatctgcaaccctctgagatatcccatcatcatgagtaaggatgcctatgtacccatggcagctgggtcctggatcataggagctgtcaattctgcagtacaatcagtgtttgtggtacaattgcctttctgcaggaataacatcatcaatcatttcacctgtgaaattctggctgtcatgaaactggcctgtgctgacatctcagacaatgagttcatcatgcttgtggccacaacattgttcatattgacacctttgttattaatcattgtctcttacacgttaatcattgtgagcatcttcaaaattagctcttccgaggggagaagcaaagcttcctctacctgttcagcccatctgactgtggtcataatattctatgggaccatcctcttcatgtacatgaagcccaagtctaaagagacacttaattcggatgacttggatgctaccgacaaaattatatccatgttctatggggtgatgactcccatgatgaatcctttaatctacagtcttagaaacaaggatgtgaaagaggcagtaaaacacctactgaacagaaggttctttagcaagtga

SEQ ID NO: 162048 - DNA, 1108 bp, Homo sapiens
  Payload ID: 11689
  Gene Symbol: OR13C3
  Gene Name: olfactory receptor, family 13, subfamily C, member 3
  Uniprot ID: Q8NGS6
  ENST ID: ENST00000374781
  CDS Start-End: 44-1087
tcagaacttcaagcaagcactccttctaatatgtgtcaaaagaatgattgttcagttaatttgtactgtttgtttcttggcagtaaatacatttcatgttagatcttcttttgatttcctgaaagcagatgacatgggtgagattaaccagacacttgtgtcagaatttcttcttctgggtctttctggatacccaaagattgagattgtttactttgctctcattctagttatgtacctagtgattctaattggcaatggtgttctaatcatagccagcatctttgattctcattttcacacaccaatgtacttcttcctgggcaacctctctttcctggatatctgctatacatcctcctctgttccctcaacattggtgagcttaatctcaaagaaaagaaacatttccttctctggatgtgcagtgcagatgttctttgggtttgcaatggggtcaacagaatgtctgcttcttggcatgatggcatttgatcgttatgtggccatctgcaacccactgagataccccatcatcctgagcaaggtggcgtatgtattgatggcttctgtgtcctggctgtccggtggaataaattcagctgtgcaaacattacttgccatgagactgcctttctgtgggaataatattatcaatcatttcgcatgtgaaatattagctgtcctcaagctggcctgtgctgatatatccctcaatattatcaccatggtgatatcaaatatggccttcctggttcttccactgatggtcatttttttctcctatatgttcatcctctacaccatcttgcaaatgaattcagccacaggaagacgcaaggcattttccacgtgctcagctcacctgactgtggtgatcatattttacggtaccatcttctttatgtatgcgaaaccgaagtctcaagacctgattggggaagaaaaattgcaagcattagacaagctcatttctctgttttatggggtagtgacacccatgctgaatcctatactctatagcttgagaaataaggatgtaaaagctgctgtaaaatatttgctgaacaaaaaaccaattcactaatgaaaccaggacatgtaggtc

SEQ ID NO: 162049 - DNA, 957 bp, Homo sapiens
  Payload ID: 11690
  Gene Symbol: OR13C4
  Gene Name: olfactory receptor, family 13, subfamily C, member 4
  Uniprot ID: Q8NGS5
  ENST ID: ENST00000277216
  CDS Start-End: 1-957
atggacaagataaaccagacatttgtgagagaattcattcttctgggactctctggttaccccaaacttgagatcattttctttgctctgattctagttatgtacgtagtgattctaattggcaatggtgttctgatcatagcaagcatcttggattctcgtcttcacatgcccatgtacttcttcctgggcaacctctctttcctggatatctgctatacaacctcctccattccctcaacactggtgagcttaatctcaaagaaaagaaacatttccttctctggatgtgcagtgcagatgttctttgggtttgcaatggggtcaacagaatgtttcctccttggcatgatggcatttgatcgttatgtggccatctgtaaccctctgagataccccatcatcatgaacaaggtggtgtatgtactgctgacttctgtatcatggctttctggtggaatcaattcaactgtgcaaacatcacttgccatgcgatggcctttctgtgggaacaatattattaatcatttcttatgcgagatcttagctgtcctaaaattagcttgttctgatatatctgtcaatattgttaccctagcagtgtcaaatattgctttcctagttcttcctctgctcgtgatttttttctcctatatgttcatcctctacaccatcttgcgaacgaactcggccacaggaagacacaaggcattttctacatgctcagctcacctgactgtggtgatcatattttatggtaccatcttctttatgtatgcaaaacctaagtcccaggacctccttgggaaagacaacttgcaagctacagaggggcttgtttccatgttttatggggttgtgacccccatgttaaaccccataatctatagcttgagaaataaagatgtaaaagctgctataaaatatttgctgagcaggaaagctattaaccagtaa

SEQ ID NO: 162050 - DNA, 957 bp, Homo sapiens
  Payload ID: 11691
  Gene Symbol: OR13C5
  Gene Name: olfactory receptor, family 13, subfamily C, member 5
  Uniprot ID: Q8NGS8
  ENST ID: ENST00000374779
  CDS Start-End: 1-957
atggaatgggaaaaccacaccattctggtggaattttttctgaagggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcagcttggccatggggacaacagagtgtgtgcttctgggcgtgatggcctttgaccgctatgtggctatctgcaaccctctgagatatcccatcatcatgagtaaggatgcctatgtacccatggcagctgggtcctggatcataggagctgtcaattctgcagtacaaacagtgtttgtggtacaattgcctttctgcaggaataacatcatcaatcatttcacctgtgaaattctagctgtcatgaaactggcctgtgctgacatctcaggcaatgagttcatcctgcttgtgaccacaacattgttcctattgacacctttgttattaattattgtctcttacacgttaatcattttgagcatcttcaaaattagctcttcggaggggagaagcaaaccttcctctacctgctcagctcgtctgactgtggtgataacattctgtgggaccatcttcctcatgtacatgaagcccaagtctcaagagacacttaattcagatgacttggatgccactgacaaacttatattcatattctacagggtgatgactcccatgatgaatcctttaatctacagtcttagaaacaaggatgtgaaggaggcagtaaaacacctactgagaagaaaaaattttaacaagtaa

SEQ ID NO: 162051 - DNA, 959 bp, Homo sapiens
  Payload ID: 11692
  Gene Symbol: OR13C7
  Gene Name: olfactory receptor, family 13, subfamily C, member 7 (gene/pseudogene)
  ENST ID: ENST00000424348
  CDS Start-End: 1-959
atggtaagtgccaatcagacagcctctgtgaccgagtttattctcctgggcctctctgcccacccaaagctggagaaaacgttctttgtgctcatcctgctgatgtacctggtgatcctactgggcaatggggtcctcatcctgatgactgtgtccaactcccacctgcacatgcccatgtacttcttcctggggaacctctccttcctggacatctgctatacaacatcctcagtccccctcatccttgacagcttcttgacccccaggaaaaccatctccttctcagcctgtgcagtgcagatgttcctctcctttgccatgggagccacagagtgtgttctcctgagcatgatggcgtttgatcgctacgtggccatctgcaacccccttaggtaccctgtggtcatgagcaaggctgcctacatgcccataaggctgccggctcctgggtagctggaagcactgcttccatggtgcagacatcccttgcaatgaggctgcccttctgtggagacaacatcatcaaccacttcacctgtgagattctggctgtcctgaagttggcctgtgctgatatctctgtcaatgtgatcagtatgggagtgaccaatgtgatcttcctgggggtcccggttctgttcatctctttctcctatgtcttcatcattgccaccatcctgaggatcccctcagctgaggggaggaaaaaggccttctccacctgctctgcccacctcacagtcgtggtcatcttctatgggaccatcctcttcatgtatgggaagcccaagtctaaggacccgctgggggcagacaagcaagaccttgcagacaaactcatttcccttttctatggggtggtgacccccatgctcaaccccatcatctacagcctgaggaacaaggatgtaaaggctgctgtgagggacttgatatttcagaaatgctttgcctag

SEQ ID NO: 162052 - DNA, 963 bp, Homo sapiens
  Payload ID: 11693
  Gene Symbol: OR13C8
  Gene Name: olfactory receptor, family 13, subfamily C, member 8
  Uniprot ID: Q8NGS7
  ENST ID: ENST00000335040
  CDS Start-End: 1-963
atggaaaggaccaacgattccacgtcgacagaatttttcctggtagggctttctgcccacccaaagctccagacagttttcttcgttctaattttgtggatgtacctgatgatcctgcttggaaatggagtccttatctcagttatcatctttgattctcacctgcacacccccatgtatttcttcctctgtaatctttccttcctcgacgtttgctacacaagttcctctgtcccactaattcttgccagctttctggcagtaaagaaaaaggtttccttctctgggtgtatggtgcaaatgtttatttcttttgccatgggggccacggagtgcatgatcttaggcacgatggcactggaccgctatgtggccatctgctacccactgagataccctgtcatcatgagcaagggtgcctatgtggccatggcagctgggtcctgggtcactgggcttgtggactcagtagtgcagacagcttttgcaatgcagttaccattctgtgctaataatgtcattaaacattttgtctgtgaaattctggctatcttgaaactggcctgtgctgatatttcaatcaatgtgattagtatgacagggtcgaatctgattgttctggttattccattgttagtaatttccatctcttacatatttattgttgccactattctgaggattccttccactgaaggaaaacataaggccttctccacctgctcagcccacctgacagtggtgattatattctatggaaccatcttcttcatgtacgcaaagcctgagtctaaagcctctgttgattcaggtaatgaagacatcattgaggccctcatctcccttttctatggagtgatgactcccatgcttaatcctctcatctatagtctgcgaaacaaggatgtaaaggctgctgtcaaaaacatactgtgtaggaaaaacttttctgatggaaaatga

SEQ ID NO: 162053 - DNA, 957 bp, Homo sapiens
  Payload ID: 11694
  Gene Symbol: OR13C9
  Gene Name: olfactory receptor, family 13, subfamily C, member 9
  Uniprot ID: Q8NGT0
  ENST ID: ENST00000259362
  CDS Start-End: 1-957
atggaatgggaaaaccaaaccattctggtggaattttttctgaagggacattctgttcacccaaggcttgagttactcttttttgtgctaatcttcataatgtatgtggtcatccttctggggaatggtactctcattttaatcagcatcttggaccctcaccttcacacccctatgtacttctttctggggaacctctccttcttggacatctgctacaccaccacctctattccctccacactagtgagcttcctttcagaaagaaagaccatttccttttctggctgtgcagtgcagatgttccttggcttggccatggggacaacagagtgtgtgcttctgggcatgatggcctttgaccgctatgtggctatctgcaaccctctgagatatcccatcatcatgagcaagaatgcctatgtacccatggctgttgggtcctggtttgcagggattgtcaactctgcagtacaaactacatttgtagtacaattgcctttctgcaggaagaatgtcatcaatcatttctcatgtgaaattctagctgtcatgaagttggcctgtgctgacatctcaggcaatgagttcctcatgcttgtggccacaatattgttcacattgatgccactgctcttgatagttatctcttactcattaatcatttccagcatcctcaagattcactcctctgaggggagaagcaaagctttctctacctgctcagcccatctgactgtggtcataatattctatgggaccatcctcttcatgtatatgaagcccaagtctaaagagacacttaattcagatgacttggatgctaccgacaaaattatatccatgttctatggggtgatgactcccatgatgaatcctttaatctacagtcttagaaacaaggatgtgaaagaggcagtaaaacacctaccgaacagaaggttctttagcaagtga

SEQ ID NO: 162054 - DNA, 1041 bp, Homo sapiens
  Payload ID: 11695
  Gene Symbol: OR13D1
  Gene Name: olfactory receptor, family 13, subfamily D, member 1
  Uniprot ID: Q8NGV5
  ENST ID: ENST00000318763
  CDS Start-End: 1-1041
atgtacagatttacagattttgatgtatcaaacatttcaatttacctgaatcatgtccttttctatactacccagcaggcaggtgacctagaacacatggagacaagaaattactctgccatgactgaattctttctggtggggctttcccaatatccagagctccagctttttctgttcctgctctgcctcatcatgtacatgataatcctcctgggaaatagcctcctcattatcatcaccatcttggattctcgcctccatactcccatgtatttctttcttggaaacctctcattcttggacatctgttacacatcctcatccattcctccaatgcttattatatttatgtctgagagaaaatccatctccttcattggctgtgctctgcagatggttgtgtcccttggcttgggctccactgagtgtgtcctcctggctgtgatggcctatgaccactatgtggccatctgcaacccactgaggtactccatcatcatgaacggagtgctgtatgtgcaaatggctgcatggtcctggatcataggctgtctgacctccctattgcaaacagttctgacaatgatgttgcctttctgtgggaataatgtcattgatcatattacctgtgaaattttggcccttctaaaacttgtttgttcagatatcaccatcaatgtgcttatcatgacagtgacaaatattgtttcactggtgattcttctactgttaattttcatctcctatgtgtttattctctcttccatcctgagaattaattgtgctgagggaagaaagaaagccttctctacctgttcagcgcactcgattgtggtcatcttattctacggttcagccctttttatgtacatgaaacccaagtcaaagaacactaatacatctgatgagattattgggctgtcttatggagtggtaagcccaatgttaaatcccatcatctatagcctcaggaataaagaggtcaaagaggctgtaaagaaagtcctgagcagacatctgcatttattgaaaatgtga

SEQ ID NO: 162055 - DNA, 960 bp, Homo sapiens
  Payload ID: 11696
  Gene Symbol: OR13F1
  Gene Name: olfactory receptor, family 13, subfamily F, member 1
  Uniprot ID: Q8NGS4
  ENST ID: ENST00000334726
  CDS Start-End: 1-960
atgttcccggcaaattggacatctgtaaaagtatttttcttcctgggattttttcactaccccaaagttcaggtcatcatatttgcggtgtgcttgctgatgtacctgatcaccttgctgggcaacatttttctgatctccatcaccattctagattcccacctgcacacccctatgtacctcttcctcagcaatctctcctttctggacatctggtactcctcttctgccctctctccaatgctggcaaactttgtttcagggagaaacactatttcattctcagggtgcgccactcagatgtacctctcccttgccatgggctccactgagtgtgtgctcctgcccatgatggcatatgaccggtatgtggccatctgcaaccccctgagataccctgtcatcatgaataggagaacctgtgtgcagattgcagctggctcctggatgacaggctgtctcactgccatggtggaaatgatgtctgtgctgccactgtctctctgtggtaatagcatcatcaatcatttcacttgtgaaattctggccatcttgaaattggtttgtgtggacacctccctggtgcagttaatcatgctggtgatcagtgtacttcttctccccatgccaatgctactcatttgtatctcttatgcatttatcctcgccagtatcctgagaatcagctcagtggaaggtcgaagtaaagccttttcaacgtgcacagcccacctgatggtggtagttttgttctatgggacggctctctccatgcacctgaagccctccgctgtagattcacaggaaatagacaaatttatggctttggtgtatgccggacaaacccccatgttgaatcctatcatctatagtctacggaacaaagaggtgaaagtggccttgaaaaaattgctgattagaaatcattttaatactgccttcatttccatcctcaaataa

SEQ ID NO: 162056 - DNA, 924 bp, Homo sapiens
  Payload ID: 11697
  Gene Symbol: OR13G1
  Gene Name: olfactory receptor, family 13, subfamily G, member 1
  Uniprot ID: Q8NGZ3
  ENST ID: ENST00000359688
  CDS Start-End: 1-924
atgaatcacagcgttgtaactgagttcattattctgggcctcaccaaaaagcctgaactccagggaattatcttcctcttttttctcattgtctatcttgtggcttttctcggcaacatgctcatcatcattgccaaaatctataacaacaccttgcatacgcccatgtatgttttccttctgacactggctgttgtggacatcatctgcacaacaagcatcataccgaagatgctggggaccatgctaacatcagaaaataccatttcatatgcaggctgcatgtcccagctcttcttgttcacatggtctctgggagctgagatggttctcttcaccaccatggcctatgaccgctatgtggccatttgtttccctcttcattacagtactattatgaaccaccatatgtgtgtagccttgctcagcatggtcatggctattgcagtcaccaattcctgggtgcacacagctcttatcatgaggttgactttctgtgggccaaacaccattgaccacttcttctgtgagatacccccattgctggctttgtcctgtagccctgtaagaatcaatgaggtgatggtgtatgttgctgatattaccctggccataggggactttattcttacctgcatctcctatggttttatcattgttgctattctccgtatccgcacagtagaaggcaagaggaaggccttctcaacatgctcatctcatctcacagtggtgaccctttactattctcctgtaatctacacctatatccgccctgcttccagctatacatttgaaagagacaaggtggtagctgcactctatactcttgtgactcccacattaaacccgatggtgtacagcttccagaatagggagatgcaggcaggaattaggaaggtgtttgcatttctgaaacactag

SEQ ID NO: 162057 - DNA, 927 bp, Homo sapiens
  Payload ID: 11698
  Gene Symbol: OR13H1
  Gene Name: olfactory receptor, family 13, subfamily H, member 1
  Uniprot ID: Q8NG92
  ENST ID: ENST00000338616
  CDS Start-End: 1-927
atggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccaggctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtatgtgtctgcttggttgctacctcatgggggacatcacttgtgctcactgccatgctcatcctatccctgaggcttcacttctgtggggctaatgtcatcaaccattttgcctgtgagattctctccctcattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctaccctgaccaggacaagtttatctcagtgttttatggagctttgacacccatgttgaaccccctgatatatagcctgagaaaaaaagatgttaaacgggcaataaggaaagttatgttgaaaaggacatga

SEQ ID NO: 162058 - DNA, 1339 bp, Homo sapiens
  Payload ID: 11699
  Gene Symbol: OR13J1
  Gene Name: olfactory receptor, family 13, subfamily J, member 1
  Uniprot ID: Q8NGT2
  ENST ID: ENST00000377981
  CDS Start-End: 201-1139
atgctcatttttcacatggataaactgaggcctagagaggataaagggattgcccgacgtcacagacagtgagtgtggcagtgctggaaaagatcctgacagtccacctcgtcccagaaagggctctgtgagcttccccgcaccctgtaccctctctccttccatcccagctgtggaccatctcttcagaactctgcagcatggagccgctcaacagaacagaggtgtccgagttctttctgaaaggattttctggctacccagccctggagcatctgctcttccctctgtgctcagccatgtacctggtgaccctcctggggaacacagccatcatggcggtgagcgtgctagatatccacctgcacacgcccgtgtacttcttcctgggcaacctctctaccctggacatctgctacacgcccacctttgtgcctctgatgctggtccacctcctgtcatcccggaagaccatctcctttgctgtctgtgccatccagatgtgtctgagcctgtccacgggctccacggagtgcctgctactggccatcacggcctatgaccgctacctggccatctgccagccactcaggtaccacgtgctcatgagccaccggctctgcgtgctgctgatgggagctgcctgggtcctctgcctcctcaagtcggtgactgagatggtcatctccatgaggctgcccttctgtggccaccacgtggtcagtcacttcacctgcaagatcctggcagtgctgaagctggcatgcggcaacacgtcggtcagcgaagacttcctgctggcgggctccatcctgctgctgcctgtacccctggcattcatctgcctgtcctacttgctcatcctggccaccatcctgagggtgccctcggccgccaggtgctgcaaagccttctccacctgcttggcacacctggctgtagtgctgcttttctacggcaccatcatcttcatgtacttgaagcccaagagtaaggaagcccacatctctgatgaggtcttcacagtcctctatgccatggtcacgaccatgctgaaccccaccatctacagcctgaggaacaaggaggtgaaggaggccgccaggaaggtgtggggcaggagtcgggcctccaggtgagggagggcggggctctgtacagacgcaggtctcaggttagtagctgaggccatcgtatgccaatgccagtgaagacatggcagggctggggctacaggtctggtatcttcatcccagcaaggcagcaccaagtcccgctgatcctgccacagaacagcccccaaatcaccctctgctctcagcatcaccctggccttcac

SEQ ID NO: 162059 - DNA, 930 bp, Homo sapiens
  Payload ID: 11700
  Gene Symbol: OR14A16
  Gene Name: olfactory receptor, family 14, subfamily A, member 16
  Uniprot ID: Q8NHC5
  ENST ID: ENST00000357627
  CDS Start-End: 1-930
atggcaaatctcacaatcgtgactgaatttatccttatggggttttctaccaataaaaatatgtgcattttgcattcgattctcttcttgttgatttatttgtgtgccctgatggggaatgtcctcattatcatgatcacaactttggaccatcatctccacacccccgtgtatttcttcttgaagaatctatctttcttggatctctgccttatttcagtcacggctcccaaatctatcgccaattctttgatacacaacaactccatttcattccttggctgtgtttcccaggtctttttgttgctttcttcagcatctgcagagctgctcctcctcacggtgatgtcctttgaccgctatactgctatatgtcaccctctgcactatgatgtcatcatggacaggagcacctgtgtccaaagagccactgtgtcttggctgtatgggggtctgattgctgtgatgcacacagctggcaccttctccttatcctactgtgggtccaacatggtccatcagttcttctgtgacattccccagttattagctatttcttgctcagaaaatttaataagagaaattgcactcatccttattaatgtagttttggatttctgctgttttattgtcatcatcattacctatgtccacgtcttctctacagtcaagaagatcccttccacagaaggccagtcaaaagcctactctatttgccttccacacttgctggttgtgttatttctttccactggattcattgcttatctgaagccagcttcagagtctccttctattttggatgctgtaatttctgtgttctacactatgctgcccccaacctttaatcccattatatacagtttgagaaacaaggccataaaggtggctctggggatgttgataaagggaaagctcaccaaaaagtaa

SEQ ID NO: 162060 - DNA, 945 bp, Homo sapiens
  Payload ID: 11701
  Gene Symbol: OR14A2
  Gene Name: olfactory receptor, family 14, subfamily A, member 2
  Uniprot ID: Q96R54
  ENST ID: ENST00000366485
  CDS Start-End: 1-945
atggccaatgtcaccttggtgacaggatttcttcttatggggttttctaatatccagaagctgcggattttatatggtgtgctcttcctactgatttacctggcagccctaatgagtaaccttctcatcattactctcattaccctggacgtaaagctccaaacacccatgtacttcttcctgaagaacttatcctttttggatgtcttcctggtgtctgttccaatcccaaaattcattgtcaacaacctaacccacaacaattccatttccattctaggatgtgccttccagctacttttaatgacttccttctcagcaggagagatatttatcctcactgccatgtcctatgaccgctatgtagccatctgctgtcccctgaactacgaggtaatcatgaatactggagtctgtgtgttaatggcaagtgtttcctgggccattggagggctctttggtactgcgtacacagctggcacattttccatgcctttctgtggctccagtgtgattccacagtttttctgtgatgttccttcattactaaggatttcctgttctgaaacactaatggtaatttatgcaggtattggagttggtgcatgtttaagcatttcttgtttcatctgtattgtgatctcttacatttatatcttctccactgtactgaagatccctaccactaaaggtcagtccaaagctttttccacatgcttcccccatctcactgttttcactgtttttatcataactgcttattttgtttatcttaagccaccttcaaattcaccatctgttattgacaggctgctttctgtgatctacactgtgatgcctccagtatttaaccctgtaacctacagcctgcggaacaatgacatgaaatgtgctctgataaggttgctgcagaaaacatatggtcaggaggcttacttcatttaa

SEQ ID NO: 162061 - DNA, 939 bp, Homo sapiens
  Payload ID: 11702
  Gene Symbol: OR14C36
  Gene Name: olfactory receptor, family 14, subfamily C, member 36
  Uniprot ID: Q8NHC7
  ENST ID: ENST00000317861
  CDS Start-End: 1-939
atgcccaattcaaccaccgtgatggaatttctcctcatgaggttttctgatgtgtggacactacagattttacattctgcatccttctttatgttgtatttggtaactctaatgggaaacatcctcattgtgaccgtcaccacctgtgacagcagccttcacatgcccatgtacttcttcctcaggaatctgtctatcttggatgcctgctacatttctgttacagtccctacctcatgtgtcaattccctactggacagcaccaccatttctaaggcgggatgtgtagctcaggtcttcctcgtggttttttttgtatatgtggagcttctgtttctcaccattatggctcatgaccgctatgtggctgtctgccagccacttcactaccctgtgatcgtgaactctcgaatctgcatccagatgacactggcctccctactcagtggtcttgtctatgcaggcatgcacactggcagcacattccagctgcccttctgtcggtccaacgttattcatcaattcttctgtgacatcccctctctgctgaagctctcttgctctgacaccttcagcaatgaggtcatgattgttgtctctgctctgggggtaggtggcggctgtttcatctttatcatcaggtcttacattcacatcttttcgaccgtgctcgggtttccaagaggagcagacagaacaaaggccttttccacctgcatccctcacatcctggtggtgtcagtcttcctcagttcatgctcttctgtgtacctcaggccacctgcgatacctgcagccacccaggatctgatcctttctggtttttattccataatgcctcccctctttaaccctattatttacagtcttagaaataagcaaataaaggtggccatcaagaaaatcatgaagagaattttttattcagaaaatgtgtaa

SEQ ID NO: 162062 - DNA, 936 bp, Homo sapiens
  Payload ID: 11703
  Gene Symbol: OR14I1
  Gene Name: olfactory receptor, family 14, subfamily I, member 1
  Uniprot ID: A6ND48
  ENST ID: ENST00000342623
  CDS Start-End: 1-936
atggacaatctcacaaaagtgacagaattcctgctgatggagttttctggtatctgggagctgcaggtgctgcacgccgggctgtttctgctgatttatctggcagtgctggtggggaacctgctcatcattgcagtcatcactctcgatcagcatcttcacacacccatgtacttcttcctgaagaacctctccgttttggatctgtgctacatctcagtcactgtgcctaaatccatccgtaactccctgactcgcagaagctccatctcttatcttggctgtgtggctcaagtctattttttctctgcctttgcatctgctgagctggccttccttactgtcatgtcttatgaccgctatgttgccatttgccaccccctccaatacagagccgtgatgacatcaggagggtgctatcagatggcagtcaccacctggctaagctgcttttcctacgcagccgtccacactggcaacatgtttcgggagcacgtttgcagatccagtgtgatccaccagttcttccgtgacatccctcatgtgttggccctggtttcctgtgaggttttctttgtagagtttttgaccctggccctgagctcatgcttggttctgggatgctttattctcatgatgatctcctatttccaaatcttctcaacggtgctcagaatcccttcaggacagagtcgagcaaaagccttctccacctgctccccccagctcattgtcatcatgctctttcttaccacagggctctttgctgccttaggaccaattgcaaaagctctgtccattcaggatttagtgattgctctgacatacacagttttgcctcccttcctcaatcccatcatatatagtcttaggaataaggagattaaaacagccatgtggagactctttgtgaagatatattttctgcaaaagtag

SEQ ID NO: 162063 - DNA, 966 bp, Homo sapiens
  Payload ID: 11704
  Gene Symbol: OR14J1
  Gene Name: olfactory receptor, family 14, subfamily J, member 1
  Uniprot ID: Q9UGF5
  ENST ID: ENST00000230221
  CDS Start-End: 1-966
atggtcaatttgacttcaatgagtggattccttcttatggggttttctgatgagcgtaagcttcagattttacatgcattggtatttctggtgacatacctgctggccttgacaggcaacctcctcattatcaccatcattaccgtggaccgtcgtctccattcccccatgtattactttttaaagcacctctctcttctggacctctgcttcatctctgtcacagtcccccagtccattgcaaattcacttatgggcaacggttacatttctcttgttcagtgcattcttcaggttttcttcttcatagctctggcctcatcagaagtggccattctcacagtgatgtcttatgacaggtacgcagcaatctgtcaaccacttcattatgagactattatggatccccgtgcctgtaggcatgcagtgatagctgtgtggattgctgggggcctctctgggctcatgcatgctgccattaacttctccatacctctctgtgggaagagagtcattcaccaattcttctgtgatgttcctcagatgctgaaactagcctgttcttatgaattcattaatgagattgcactggctgcattcacaacgtctgcagcatttatctgtttgatctccattgtgctctcctacattcgcatcttctctacagtgctgagaatcccatcagctgagggccggaccaaggtcttctccacctgcctaccacacctatttgtagccaccttctttctttcagctgcaggctttgagtttctcagactgccttctgattcctcatcgactgtggaccttgtattctccgtattctatactgtgatacctccaacactcaatccagtcatttatagcttacggaatgattccatgaaggcagcactgaggaagatgctgtcaaaggaagagcttcctcagagaaaaatgtgcttaaaagccatgtttaaactctga

SEQ ID NO: 162064 - DNA, 966 bp, Homo sapiens; identical to SEQ ID NO: 162063
  Payload ID: 11704
  Gene Symbol: OR14J1
  Gene Name: olfactory receptor, family 14, subfamily J, member 1
  Uniprot ID: Q9UGF5
  ENST ID: ENST00000377160
  CDS Start-End: 1-966

SEQ ID NO: 162065 - DNA, 966 bp, Homo sapiens
  Payload ID: 11704
  Gene Symbol: OR14J1
  Gene Name: olfactory receptor, family 14, subfamily J, member 1
  Uniprot ID: Q9UGF5
  ENST ID: ENST00000420495
  CDS Start-End: 1-966
atggtcaatttgacttcaacgagtggattccttcttatggggttttctgatgagcgtaagcttcagattttacatgcattggtatttctggtgacatacctgctggccttgacaggcaacctcctcattatcaccatcattaccgtggaccgtcgtctccattcccccatgtattactttttaaagcacctctctcttctggacctctgcttcatctctgtcacagtcccccagtccattgcaaattcacttatgggcaacggttacatttctcttgttcagtgcattcttcaggttttcttcttcatagctctggcctcatcagaagtggccattctcacagtgatgtcttatgacaggtacgcagcaatctgtcaaccacttcattatgagactattatggatccccgtgcctgtaggcatgcagtgatagctgtgtggattgctgggggcctctctgggctcatgcatgctgccattaacttctccatacctctctgtgggaagagagtcattcaccaattcttctgtgatgttcctcagatgctgaaactagcctgttcttatgaattcattaatgagattgcactggctgcattcacaacgtctgcagcatttatctgtttgatctccattgtgctctcctacattcgcatcttctctacagtgctgagaatcccatcagctgagggccggaccaaggtcttctccacctgcctaccacacctatttgtagccaccttctttctttcagctgcaggctttgagtttctcagactgccttctgattcctcatcgactgtggaccttgtattctccgtattctatactgtgatacctccaacactcaatccagtcatttatagcttacggaatgattccatgaaggcagcactgaggaagatgctgtcaaaggaagagcttcctcagagaaaaatgtgcttaaaagccatgtttaaactctga

SEQ ID NO: 162066 - DNA, 966 bp, Homo sapiens; identical to SEQ ID NO: 162063
  Payload ID: 11704
  Gene Symbol: OR14J1
  Gene Name: olfactory receptor, family 14, subfamily J, member 1
  Uniprot ID: Q9UGF5
  ENST ID: ENST00000434778
  CDS Start-End: 1-966

SEQ ID NO: 162067 - DNA, 966 bp, Homo sapiens; identical to SEQ ID NO: 162065
  Payload ID: 11704
  Gene Symbol: OR14J1
  Gene Name: olfactory receptor, family 14, subfamily J, member 1
  Uniprot ID: Q9UGF5
  ENST ID: ENST00000435798
  CDS Start-End: 1-966

SEQ ID NO: 162068 - DNA, 966 bp, Homo sapiens; identical to SEQ ID NO: 162065
  Payload ID: 11704
  Gene Symbol: OR14J1
  Gene Name: olfactory receptor, family 14, subfamily J, member 1
  Uniprot ID: Q9UGF5
  ENST ID: ENST00000421489
  CDS Start-End: 1-966

SEQ ID NO: 162069 - DNA, 966 bp, Homo sapiens; identical to SEQ ID NO: 162065
  Payload ID: 11704
  Gene Symbol: OR14J1
  Gene Name: olfactory receptor, family 14, subfamily J, member 1
  Uniprot ID: Q9UGF5
  ENST ID: ENST00000451272
  CDS Start-End: 1-966

SEQ ID NO: 162070 - DNA, 945 bp, Homo sapiens
  Payload ID: 11705
  Gene Symbol: OR14K1
  Gene Name: olfactory receptor, family 14, subfamily K, member 1
  Uniprot ID: Q8NGZ2
  ENST ID: ENST00000283225
  CDS Start-End: 1-945
atgaccaatcagacacagatgatggaattcttgcttgtgagatttactgagaattgggtgctcctgaggctgcatgctttgctcttctcactgatctacctcacggctgtgctgatgaatttagtcatcattctcctcatgattctggaccatcgtctccacatggcaatgtactttttcctccgacatttgtccttcttagacctgtgtctcatttctgccacagtccccaaatccatcctcaactctgtcgcctccactgactccatctccttcctggggtgtgtgttgcagctcttcttggtggtactgctggctggatcagagattggcatccttactgccatgtcctatgaccgctatgctgccatctgctgccccctacactgtgaggctgtcatgagcagagggctctgtgtccagttgatggctctgtcctggctcaacagaggggccttgggactcttgtacacagctggaacattctctctgaatttttatggctctgatgagctacatcagttcttctgcgatgtccctgccctactaaagctcacttgttctaaagaacatgccatcattagtgtcagtgtggccattggggtctgttatgcattttcatgtttagtttgcattgtagtttcctatgtgtacattttctctgctgtgttaaggatatcacagagacagagacaatccaaagccttttccaactgtgtgcctcacctcattgttgtcactgtgtttcttgtaacaggtgctgttgcttatttaaagccagggtctgatgcaccttctattctagacttgctggtgtctgtgttctattctgtcgcacctccaaccttgaaccctgttatctactgtctgaagaacaaggacattaaatccgctctgagtaaagtcctgtggaatgttagaagcagtggggtaatgaaaagatga

SEQ ID NO: 162071 - DNA, 933 bp, Homo sapiens
  Payload ID: 11706
  Gene Symbol: OR2A1
  Gene Name: olfactory receptor, family 2, subfamily A, member 1
  Uniprot ID: Q8NGT9
  ENST ID: ENST00000408951
  CDS Start-End: 1-933
atgggggaaaatcagacaatggtcacagagttcctcctactgggatttctcctgggcccaaggattcagatgctcctctttgggctcttctccctgttctatatcttcaccctgctggggaacggggccatcctggggctcatctcactggactccagactccacacccccatgtacttcttcctctcacacctggctgtcgtcgacatcgcctacacccgcaacacggtgccccagatgctggcgaacctcctgcatccagccaagcccatctcctttgctggctgcatgacgcagacctttctctgtttgagttttggacacagcgaatgtctcctgctggtgctgatgtcctacgatcgttacgtggccatctgccaccctctccgatactccgtcatcatgacctggagagtctgcatcaccctggccgtcacttcctggacgtgtggctccctcctggctctggcccatgtggttctcatcctaagactgcccttctctgggcctcatgaaatcaaccacttcttctgtgaaatcctgtctgtcctcaggctggcctgtgctgacacctggctcaaccaggtggtcatctttgcagcctgcgtgttcttcctggtggggccacccagcctggtgcttgtctcctactcgcacatcctggcggccatcctgaggatccagtctggggagggccgcagaaaggccttctccacctgctcctcccacctctgcgtggtgggactcttctttggcagtgccatcatcatgtacatggcccccaagtcccgccatcctgaggagcagcaaaaggtcttttttctattttacagttttttcaacccaacacttaaccccctgatttacagcctgaggaacggagaggtcaagggtgccctgaggagagcactgggcaaggaaagtcattcctaa

SEQ ID NO: 162072 - DNA, 1046 bp, Homo sapiens
  Payload ID: 11707
  Gene Symbol: OR2A12
  Gene Name: olfactory receptor, family 2, subfamily A, member 12
  Uniprot ID: Q8NGT7
  ENST ID: ENST00000408949
  CDS Start-End: 61-993
tcccattagctgtgaaatttctgtcttaagtacatcacaagatttttctgtcacgagaacatggaaagcaatcagacctggatcacagaagtcatcctgttgggattccaggtggacccagctctggagttgttcctctttgggtttttcttgctattctacagcttaaccctgatgggaaatgggattatcctggggctcatctacttggactctagactgcacacacccatgtatgtcttcctgtcacacctggccattgtggacatgtcctatgcctcgagtactgtccctaagatgctagcaaatcttgtgatgcacaaaaaagtcatctcctttgctccttgcatacttcagacttttttgtatttggcgtttgctattacagagtgtctgattttggtgatgatgtgctatgatcggtatgtggcaatctgtcaccccttgcaatacaccctcattatgaactggagagtgtgcactgtcctggcctcaacttgctggatatttagctttctcttggctctggtccatattactcttattctgaggctgcctttttgtggcccacaaaagatcaaccactttttctgtcaaatcatgtccgtattcaaattggcctgtgctgacactaggctcaaccaggtggtcctatttgcgggttctgcgttcatcttagtggggccgctctgcctggtgctggtctcctacttgcacatcctggtggccatcttgaggatccagtctggggagggccgcagaaaggccttctctacctgctcctcccacctctgcgtggtggggcttttctttggcagcgccattgtcatgtacatggcccccaagtcaagccattctcaagaacggaggaagatcctttccctgttttacagccttttcaacccgatcctgaaccccctcatctacagccttaggaatgcagaggtgaaaggggctctaaagagagtcctttggaaacagagatcaatgtgaagaatcatttgagatatcctgagtgtgtaagcatggttctcatgaccctgggt

SEQ ID NO: 162073 - DNA, 1012 bp, Homo sapiens
  Payload ID: 11708
  Gene Symbol: OR2A14
  Gene Name: olfactory receptor, family 2, subfamily A, member 14
  Uniprot ID: Q96R47
  ENST ID: ENST00000408899
  CDS Start-End: 56-988
gcatctttgactggcccacagctctgaccttcctgtcctagatgtccacaagagcatggaaggcaacaagacatggatcacagacatcaccttgccgcgattccaggttggtccagcactggagattctcctctgtggacttttctctgccttctatacactcaccctgctggggaatggggtcatctttgggattatctgcctggactgtaagcttcacacacccatgtacttcttcctctcacacctggccattgttgacatatcctatgcttccaactatgtccccaagatgctgacgaatcttatgaaccaggaaagcaccatctccttttttccatgcataatgcagacattcttgtatttggcttttgctcacgtagagtgtctgattttggtggtgatgtcctatgatcgctatgcggacatctgccaccccttacgttacaatagcctcatgagctggagagtgtgcactgtcctggctgtggcttcctgggtgttcagcttcctcctggctctggtccctttagttctcatcctgagcctgcccttctgcgggcctcatgaaatcaaccacttcttctgtgaaatcctgtctgtcctcaagttggcctgtgctgacacctggctcaaccaggtggtcatctttgcagcctgcgtgttcatcctggtggggccactctgcctggtgctggtctcctacttgcgcatcctggccgccatcttgaggatccagtctggggagggccgcagaaaggccttctccacctgctcctcccacctttgcgtggtgggactcttctttggcagcgccattgtcacgtacatggcccccaagtcccgccatcctgaggagcagcagaaagttctttccctgttttacagccttttcaatccaatgctgaaccccctgatatatagcctaaggaatgcagaggtcaagggcgccctgaggagggcactgaggaaggagaggctgacgtgagacatctcaaagggaaccatgggg

SEQ ID NO: 162074 - DNA, 924 bp, Homo sapiens
  Payload ID: 11708
  Gene Symbol: OR2A14
  Gene Name: olfactory receptor, family 2, subfamily A, member 14
  ENST ID: ENST00000627593
  CDS Start-End: 1-924
atggaaggcaaccagacatggatcacagacatcaccctgctgggattccaggttggtccagcactggcgattctcctctgtggactcttctctgtcttctatacactcaccctgctggggaatggggtcatctttgggattatctgcctggactctaagcttcacacacccatgtacttcttcctctcacacctggccatcattgacatgtcctatgcttccaacaatgttcccaagatgttggcaaacctaatgaaccagaaaagaaccatctcctttgttccatgcataatgcagacttttttgtatttggcttttgctgttacagagtgcctgattttggtggtgatgtcctatgataggtatgtggccatctgccaccctttccagtacactgtcatcatgagctggagagtgtgcactgtcctggctgtggcttcctgggtgttcagcttcctcctggctctggtccctttagttctcatcctgagcctgcccttctgcgggcctcatgaaatcaaccacttcttctgtgaaatcctgtctgtcctcaagttggcctgtgctgacacctggctcaaccaggtggtcatctttgcagcctgcgtgttcatcctggtggggccactctgcctggtgctggtctcctacttgcgcatcctggccgccatcttgaggatccagtctggggagggccgcagaaaggccttctccacctgctcctcccacctttgcgtggtgggactcttctttggcagcgccattgtcacgtacatggcccccaagtcccgccatcctgaggagcagcagaaagttctttccctgttttacagccttttcaatccaatgctgaaccccctgatatatagcctaaggaatgcagaggtcaagggcgccctgaggagggcactgaggaaggagagg

SEQ ID NO: 162075 - DNA, 1051 bp, Homo sapiens
  Payload ID: 11709
  Gene Symbol: OR2A2
  Gene Name: olfactory receptor, family 2, subfamily A, member 2
  Uniprot ID: Q6IF42
  ENST ID: ENST00000408979
  CDS Start-End: 70-1026
tgcatctttgacccacagctctgaccttcctgtcctagatgagggtttgtctttctctgccacaagagcatggaaggcaaccagacatggatcacagacatcaccctgctgggattccaggttggtccagcactggcgattctcctctgtggactcttctctgtcttctatacactcaccctgctggggaatggggtcatctttgggattatctgcctggactctaagcttcacacacccatgtacttcttcctctcacacctggccatcattgacatgtcctatgcttccaacaatgttcccaagatgttggcaaacctaatgaaccagaaaagaaccatctcctttgttccatgcataatgcagacttttttgtatttggcttttgctgttacagagtgcctgattttggtggtgatgtcctatgataggtatgtggccatctgccaccctttccagtacactgtcatcatgagctggagagtgtgcacgatcctggttctcacgtcctggtcatgtgggtttgccctgtccctggtacatgaaattctccttctaaggttgcccttctgtgggccccgggatgtgaaccacctcttctgtgaaattctgtctgtcctcaagctggcctgtgctgacacctgggttaaccaagtggtcatatttgctacctgtgtgtttgtcttagtcgggcctctttccttgattctggtctcctacatgcacatcctcggggccatcctgaagatccagacaaaggagggccgcataaaggccttctccacctgctcctcccacctgtgtgtggttggactattctttggcatagccatggtggtttacatggtcccagactctaatcaacgagaggagcaggagaaaatgctgtccctgtttcacagtgtctttaatccaatgctgaaccccctgatctacagcctgaggaatgctcagttgaagggcgccctccacagagcactccagaggaagaggtccatgagaacggtgtatgggctttgcctttaaaacatgtggtttgctgaagcaagaa

SEQ ID NO: 162076 - DNA, 1014 bp, Homo sapiens
  Payload ID: 11710
  Gene Symbol: OR2A25
  Gene Name: olfactory receptor, family 2, subfamily A, member 25
  Uniprot ID: A4D2G3
  ENST ID: ENST00000408898
  CDS Start-End: 39-971
ttcagacttggtgagctccttgtttcttctacagggaaatggggggaaatcagacttccatcacagagttcctcctactgggatttcccattggcccaaggattcagatgctcctctttgggctcttctccctgttctacatcttcattctgttggggaacgggacaatcctggggctcatctcactggactccagactccacacccccatgtacttcttcctctcacacctggcggtcgtcgacatcgcctgtgcttgcagcacggtgccccagatgctggtgaacctcctgcatccagccaagcccatctcctttgctggctgcatgacccagatgtttctgtttttgagttttgcacatacagaatgtctcctcctggtggtgatgtcctatgatcggtacgtggccatctgccaccctctccgatattctaccatcatgacctggaaagtctgcatcactttggcattgacttcctggattttaggagtcttattggcccttgtccatctagtgttactgctaccactgtccttctgtggaccccagaaacttaatcactttttctgtgaaattatggctgttctcaaacttgcctgtgcggatacccacattaatgaggtaatggttttggcaggggcagtgtctgtgctggtgggagccttcttttccactgtaatatcttatgttcatattctatgtgccattctaaagatccagtcaggagaggggtgccagaaagccttctccatctgctcctcccacctctgtgtggttggactcttttatggcacagccatcatcatgtatgttgagccccagtatgagagccccaaggagcagaagaaatatctcctgctgtttcacagcctcttcaatcccatgcttaatcccctaatttatagtcttaggaacaaggaagtccaaggtactctaaagaggatgcttgaaaagaagagaacttcatgaaagcctgaaagaatagtaaaatagctggcttcaaagggctttg

SEQ ID NO: 162077 - DNA, 933 bp, Homo sapiens
  Payload ID: 11711
  Gene Symbol: OR2A4
  Gene Name: olfactory receptor, family 2, subfamily A, member 4
  Uniprot ID: O95047
  ENST ID: ENST00000315453
  CDS Start-End: 1-933
atgggagacaatataacatccatcagagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctggcggtcgtcgacatcgcctacgcctgcaacacggtgccccggatgctggtgaacctcctgcatccagccaagcccatctcctttgcgggccgcatgatgcagacctttctgttttccacttttgctgtcacagaatgtctcctcctggtggtgatgtcctatgatctgtacgtggccatctgccaccccctccgatatttggccatcatgacctggagagtctgcatcaccctcgcggtgacttcctggaccactggagtccttttatccttgattcatcttgtgttacttctacctttacccttctgtaggccccagaaaatttatcactttttttgtgaaatcttggctgttctcaaacttgcctgtgcagatacccacatcaatgagaacatggtcttggccggagcaatttctgggctggtgggacccttgtccacaattgtagtttcatatatgtgcatcctctgtgctatccttcagatccaatcaagggaagttcagaggaaagccttccgcacctgcttctcccacctctgtgtgattggactcgtttatggcacagccattatcatgtatgttggacccagatatgggaaccccaaggagcagaagaaatatctcctgctgtttcacagcctctttaatcccatgctcaatccccttatctgtagtcttaggaactcagaagtgaagaatactttgaagagagtgctgggagtagaaagggctttatga

SEQ ID NO: 162078 - DNA, 933 bp, Homo sapiens
  Payload ID: 11712
  Gene Symbol: OR2A42
  Gene Name: olfactory receptor, family 2, subfamily A, member 42
  Uniprot ID: Q8NGT9
  ENST ID: ENST00000391496
  CDS Start-End: 1-933
atgggggaaaatcagacaatggtcacagagttcctcctactgggatttctcctgggcccaaggattcagatgctcctctttgggctcttctccctgttctatatcttcaccctgctggggaacggggccatcctggggctcatctcactggactccagactccacacccccatgtacttcttcctctcacacctggctgtcgtcgacatcgcctacacccgcaacacggtgccccagatgctggcgaacctcctgcatccagccaagcccatctcctttgctggttgcatgacgcagacctttctctgtttgagttttggacacagcgaatgtctcctgctggtgctgatgtcctacgatcgttacgtggccatctgccaccctctccgatactccgtcatcatgacctggagagtctgcatcaccctggccgtcacttcctggacgtgtggctccctcctggctctggcccatgtggttctcatcctaagactgcccttctctgggcctcatgaaatcaaccacttcttctgtgaaatcctgtctgtcctcaggctggcctgtgctgacacctggctcaaccaggtggtcatctttgcagcctgcgtgttcttcctggtggggccacccagcctggtgcttgtctcctactcgcacatcctggcggccatcctgaggatccagtctggggagggccgcagaaaggccttctccacctgctcctcccacctctgcgtggtgggactcttctttggcagtgccatcatcatgtacatggcccccaagtcccgccatcctgaggagcagcaaaaggtcttttttctattttacagttttttcaacccaacacttaaccccctgatttacagcctgaggaacggagaggtcaagggtgccctgaggagagcactgggcaaggaaagtcattcctaa

SEQ ID NO: 162079 - DNA, 1013 bp, Homo sapiens
  Payload ID: 11713
  Gene Symbol: OR2A5
  Gene Name: olfactory receptor, family 2, subfamily A, member 5
  Uniprot ID: Q96R48
  ENST ID: ENST00000408906
  CDS Start-End: 35-970
cagcagagtccaacgcaggtactgtcacaagggcatgacaaaaaatcagacatgggtcacagaattcattctcctgggatttccactcagcctaaggattcagatgctcctctctgggcttttctccctgttatacgtcttcaccctgctgggaaatggggccatcctggggctcatctggctggactccagactgcacacccccatgtacttctttctctcacacctggccatcattgatatttcgtatgcttccaacaatgtccccaagatgctgacaaaccttggcttgaacaagagaaaaacaatctcctttgtcccatgcacaatgcagacctttttatacatggcttttgctcacactgagtgtctcatcttggtaatgatgtcctacgatcggtacatggctatctgccaccctctgcaatattctgtcatcatgagatggggagtgtgcacagtcctggctgtcacttcttgggcatgtggttcccttctggccctggtccatgtggttctcatcctgaggctgcccttctgtgggccccatgaaatcaaccacttcttctgtgaaatcctgtctgtcctcaagttggcctgtgctgacacctggctcaaccaggtggtcatctttgctgcttcagtgttcatcctggtggggccgctctgcctggtgctggtctcctactcgcgcatcctggcggccatcttgaggatccagtctggggagggccgcagaaaggccttctccacctgctcctcccacctttgcatggtgggactcttctttggcagcgccattgtcatgtacatggcccccaagtcccgccaccctgaggagcagcagaaggtcctttccctgttttacagccttttcaacccgatgctgaaccccttgatctatagcctgaggaacgcagaggtcaagggtgccctgaaaagagtgttgtggaaacagagatcaaagtgagggatgccagggaaagtctagagggttgaagatttgctcccaa

SEQ ID NO: 162080 - DNA, 1116 bp, Homo sapiens
  Payload ID: 11714
  Gene Symbol: OR2A7
  Gene Name: olfactory receptor, family 2, subfamily A, member 7
  Uniprot ID: Q96R45
  ENST ID: ENST00000493325
  CDS Start-End: 95-1027
tcaccaaagagtgccgaacaagttaaaatgaatctgtttttaaacacttctcctaaaccatgagcattaacttgatttcctctgtcatagggatatgggggacaatataacatccatcacagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctggcggtcgtcgacatcgcctacgcctgcaacacggtgccccggatgctggtgaacctcctgcatccagccaagcccatctcctttgcgggccgcatgatgcagacctttctgttttccacttttgctgtcacagaatgtctcctcctggtggtgatgtcctatgatctgtacgtggccatctgccaccccctccgatatttggccatcatgacctggagagtctgcatcaccctcgcggtgacttcctggaccactggagtccttttatccttgattcatcttgtgttacttctacctttacccttctgtaggccccagaaaatttatcactttttttgtgaaatcttggctgttctcaaacttgcctgtgcagatacccacatcaatgagaacatggtcttggccggagcaatttctgggctggtgggacccttgtccacaattgtagtttcatatatgtgcatcctctgtgctatccttcagatccaatcaagggaagttcagaggaaagccttctgcacctgcttctcccacctctgtgtgattggactcttttatggcacagccattatcatgtatgttggacccagatatgggaaccccaaggagcagaagaaatatctcctgctgtttcacagcctctttaatcccatgctcaatccccttatctgtagtcttaggaactcagaagtgaagaatactttgaagagagtgctgggagtagaaagggctttatgaaaaggattatggcattgtgactgacagtgacctaggaagttacatcattgagcggttcttaacccatctctgcactggtgggacctctg

SEQ ID NO: 162081 - DNA, 1071 bp, Homo sapiens
  Payload ID: 11715
  Gene Symbol: OR2AE1
  Gene Name: olfactory receptor, family 2, subfamily AE, member 1
  Uniprot ID: Q8NHA4
  ENST ID: ENST00000316368
  CDS Start-End: 25-996
cctcagggattgagaaaggggacaatgtggcagaagaatcagacctctctggcagacttcatccttgaggggctcttcgatgactcccttacccaccttttccttttctccttgaccatggtggtcttccttattgcggtgagtggcaacaccctcaccattctcctcatctgcattgatccccagcttcatacaccaatgtatttcctgctcagccagctctccctcatggatctgatgcatgtctccacaatcatcctgaagatggctaccaactacctatctggcaagaaatctatctcctttgtgggctgtgcaacccagcacttcctctatttgtgtctaggtggtgctgaatgttttctcttagctgtcatgtcctatgaccgctatgttgccatctgtcatccactgcgctatgctgtgctcatgaacaagaaggtgggactgatgatggctgtcatgtcatggttgggggcatccgtgaactccctaattcacatggcgatcttgatgcacttccctttctgtgggcctcggaaagtctaccacttctactgtgagttcccagctgttgtgaagttggtatgtggcgacatcactgtgtatgagaccacagtgtacatcagcagcattctcctcctcctccccatcttcctgatttctacatcctatgtcttcatccttcaaagtgtcattcagatgcgctcatctgggagcaagagaaatgcctttgccacttgtggctcccacctcacggtggtttctctttggtttggtgcctgcatcttctcctacatgagacccaggtcccagtgcactctattgcagaacaaagttggttctgtgttctacagcatcattacgcccacattgaattctctgatttatactctccggaataaagatgtagctaaggctctgagaagagtgctgaggagagatgttatcacccagtgcattcaacgactgcaattgtggttgccccgagtgtagagtggaataggataagctccttaaattaattcatataaacctctaaagtttttcagggagatagcttccttatgc

SEQ ID NO: 162082 - DNA, 998 bp, Homo sapiens
  Payload ID: 11716
  Gene Symbol: OR2AG1
  Gene Name: olfactory receptor, family 2, subfamily AG, member 1 (gene/pseudogene)
  Uniprot ID: Q9H205
  ENST ID: ENST00000307401
  CDS Start-End: 22-972
ggtgatgaaagaaaccacagcatggagctctggaacttcaccttgggaagtggcttcattttggtggggattctgaatgacagtgggtctcctgaactgctctgtgctacaattacaatcctatacttgttggccctgatcagcaatggcctactgctcctggctatcaccatggaagcccggctccacatgcccatgtacctcctgcttgggcagctctctctcatggacctcctgttcacatctgttgtcactcccaaggcccttgcggactttctgcgcagagaaaacaccatctcctttggaggctgtgcccttcagatgttcctggcactgacaatgggtggtgctgaggacctcctactggccttcatggcctatgacaggtatgtggccatttgtcatcctctgacatacatgaccctcatgagctcaagagcctgctggctcatggtggccacgtcctggatcctggcatccctaagtgccctaatatataccgtgtataccatgcactatcccttctgcagggcccaggagatcaggcatcttctctgtgagatcccacacttgctgaaggtggcctgtgctgatacctccagatatgagctcatggtatatgtgatgggtgtgaccttcctgattccctctcttgctgctatactggcctcctatacacaaattctactcactgtgctccatatgccatcaaatgaggggaggaagaaagcccttgtcacctgctcttcccacctgactgtggttgggatgttctatggagctgccacattcatgtatgtcttgcccagttccttccacagcaccagacaagacaacatcatctctgttttctacacaattgtcactccagccctgaatccactcatctacagcctgaggaataaggaggtcatgcgggccttgaggagggtcctgggaaaatacatgctgccagcacactccacgctctagggaaggatcatggctagcttccagaa

SEQ ID NO: 162083 - DNA, 998 bp, Homo sapiens; identical to SEQ ID NO: 162082
  Payload ID: 11716
  Gene Symbol: OR2AG1
  Gene Name: olfactory receptor, family 2, subfamily AG, member 1 (gene/pseudogene)
  Uniprot ID: Q9H205
  ENST ID: ENST00000624502
  CDS Start-End: 22-972

SEQ ID NO: 162084 - DNA, 951 bp, Homo sapiens
  Payload ID: 11716
  Gene Symbol: OR2AG1
  Gene Name: olfactory receptor, family 2, subfamily AG, member 1 (gene/pseudogene)
  Uniprot ID: Q9H205
  ENST ID: ENST00000623437
  CDS Start-End: 1-951
atggagctctggaacttcaccttgggaagtggcttcattttggtggggattctgaatgacagtgggtctcctgaactgctctgtgctacaattacaatcctatacttgttggccctgatcagcaatggcctactgctcctggctatcaccatggaagcccggctccacatgcccatgtacctcctgcttgggcagctctctctcatggacctcctgttcacatctgttgtcactcccaaggcccttgcggactttctgcgcagagaaaacaccatctcctttggaggctgtgcccttcagatgttcctggcactgacaatgggtggtgctgaggacctcctactggccttcatggcctatgacaggtatgtggccatttgtcatcctctgacatacatgaccctcatgagctcaagagcctgctggctcatggtggccacgtcctggatcctggcatccctaagtgccctaatatataccgtgtataccatgcactatcccttctgcagggcccaggagatcaggcatcttctctgtgagatcccacacttgctgaaggtggcctgtgctgatacctccagatatgagctcatggtatatgtgatgggtgtgaccttcctgattccctctcttgctgctatactggcctcctatacacaaattctactcactgtgctccatatgccatcaaatgaggggaggaagaaagcccttgtcacctgctcttcccacctgactgtggttgggatgttctatggagctgccacattcatgtatgtcttgcccagttccttccacagcaccagacaagacaacatcatctctgttttctacacaattgtcactccagccctgaatccactcatctacagcctgaggaataaggaggtcatgcgggccttgaggagggtcctgggaaaatacatgctgccagcacactccacgctctag

SEQ ID NO: 162085 - DNA, 1069 bp, Homo sapiens
  Payload ID: 11717
  Gene Symbol: OR2AG2
  Gene Name: olfactory receptor, family 2, subfamily AG, member 2
  Uniprot ID: A6NM03
  ENST ID: ENST00000338569
  CDS Start-End: 99-1049
tgcacagtgacctagaacaatccaaagctagagtgaacacctttagaaaagcttccactgataatatatttggttctaggcaactaaaaaaacacatcatggagctccggaactccaccttgggaagcggcttcatcttggtggggattctgaatgacagtgggtctcctgaactgctctatgctacatttacaatcctatacatgttggcactgaccagcaatggtctgctgctcctggccatcaccatagaagcccggctccacatgcccatgtacctcctgcttgggcagctctctctcatggacctcctgttcacatctgttgtcactcccaaggcccttgcggactttctgcgcagagaaaacactatctcctttggaggctgtgcacttcagatgttcctggcactgacaatgggtagcgctgaggacctcctactggccttcatggcctatgacaggtatgtggccatttgtcatcctctgaaatacatgaccctcatgagcccaagagtctgctggatcatggtggccacatcctggatcctggcatccctgattgctataggacataccatgtacactatgcacctccctttctgtgtgtcctgggaaatcaggcatctgctctgtgagatcccacccttgctgaagttggcctgtgctgatacctccaggtatgagcttataatatacgtgacaggtgtgactttcctcttgctccccatttctgccattgtggcctcctacacactagtcctattcactgtgcttcgtatgccatcaaatgaggggaggaagaaagcccttgtcacctgctcttcccacctgattgtggtcgggatgttctatggagctgccacattcatgtatgtcttgcccagttccttccacagccccaaacaagacaacatcatctctgttttctacacaattgtcactccagccctgaatccactcatctacagcctgaggaataaggaggtcatgcgggccttgaggagggtcctgggaaaatacatactgctggcacattccacgctctagggaaggatcatggcttgcct

SEQ ID NO: 162086 - DNA, 987 bp, Homo sapiens
  Payload ID: 11718
  Gene Symbol: OR2AJ1
  Gene Name: olfactory receptor, family 2, subfamily AJ, member 1
  Uniprot ID: Q8NGZ0
  ENST ID: ENST00000318244
  CDS Start-End: 1-987
atgggccatcagaatcacactttcagcagtgatttcatacttttgggattgttctcttcttccccaacaagtgtggtcttcttcttagttttatttgtcattttcattatgagtgtaacagaaaatacgctcatgatcctcctcattcgcagtgactcccgactccacactccaatgtattttctgctcagccatctctccttaatggatatcttgcatgtttccaacatcgttcccaaaatggtcactaactttctgtcaggcagcagaactatttcatttgcaggttgtgggttccaggtatttctgtccctcaccctcctgggtggtgagtgccttctcctggctgcaatgtcctgtgatcgctatgtggctatctgtcacccgctgcgctatccgattcttatgaaggagtatgccagcgctctcatggctggaggctcctggctcattggggttttcaactccacagtccacacagcttatgcactgcagtttcccttctgtggctctagggcaattgatcacttcttctgtgaagtccctgccatgttgaagttgtcctgtgcagacacaacacgctatgaacgaggggtttgtgtaagtgctgtgatcttcctgctgatccctttctccttgatctctgcttcttatggccaaattattcttactgtcctccagatgaaatcatcagaggcaaggaaaaagtcattttccacttgttccttccacatgattgtggtcacgatgtactatgggccatttatttttacatatatgagacctaaatcataccacactccaggccaggataagttcctggcaatattctatacgatcctcacacccacactcaaccctttcatctacagctttaggaataaagatgttctggcggtgatgaaaaatatgctcaaaagtaactttctgcacaaaaaaatgaataggaaaattcctgaatgtgtgttctgtctatttctatgttaa

SEQ ID NO: 162087 - DNA, 1107 bp, Homo sapiens
  Payload ID: 11719
  Gene Symbol: OR2AK2
  Gene Name: olfactory receptor, family 2, subfamily AK, member 2
  Uniprot ID: Q8NG84
  ENST ID: ENST00000366480
  CDS Start-End: 100-1107
tgctctaaacatgtagatagttgccaaacatgtaagtgaatatttatttctgaatgccatgtcattttactttctcttaagggaagtcaacattattacatgaacatttcagatgtcatctcctttgatattttggtttcagccatgaaaacaggaaatcaaagttttgggacagattttctacttgttggtcttttccaatatggctggataaactctcttctctttgtcgtcattgccaccctctttacagttgctctgacaggaaatatcatgctgatccacctcattcgactgaacaccagactccacactccaatgtactttctgctcagtcagctctccatcgttgacctcatgtacatctccaccacagtgcccaagatggcagtcagcttcctctcacagagtaagaccattagatttttgggctgtgagattcaaacgtatgtgttcttggcccttggtggaactgaagcccttctccttggttttatgtcttatgatcgctatgtagctatctgtcaccctttacattatcctatgcttatgagcaagaagatctgctgcctcatggttgcatgtgcatgggccagtggttctatcaatgctttcatacatacattgtatgtgtttcagcttccattctgtaggtctcggctcattaaccactttttctgtgaagttccagctctactatcattggtgtgtcaggacacctcccagtatgagtatacagtcctcctgagtggacttattatcttgctactaccattcctagccattctggcttcctatgctcgtgtgcttattgtggtattccagatgagctcaggaaaaggacaggcaaaagctgtttccacttgttcctcccacctgattgtggcaagcctgttctatgcaaccactctctttacctacacaaggccacactccttgcgttccccttcacgggataaggcggtggcagtattttacaccattgtcacacctctactgaacccatttatctacagcctgagaaataaggaagtgacgggggcagtgaggagactgttgggatattggatatgctgtagaaaatatgacttcagatctctgtattga

SEQ ID NO: 162088 - DNA, 930 bp, Homo sapiens
  Payload ID: 11720
  Gene Symbol: OR2AP1
  Gene Name: olfactory receptor, family 2, subfamily AP, member 1
  Uniprot ID: Q8NGE2
  ENST ID: ENST00000321688
  CDS Start-End: 1-930
atgaaaaataaaaccgtgttaactgagtttatccttctgggtctaacagatgtccctgaactccaggtggcagttttcacctttcttttccttgcgtatttactcagcatccttggaaatctgactatcctcatcctcaccttgctggactcccaccttcagactcccatgtatttctttctccggaacttctccttcttggaaatttccttcacaaacatcttcattccaagggtcctgattagcatcacaacagggaacaagagtatcagctttgctggctgcttcactcagtatttctttgccatgttccttggggctacagagttttaccttctggctgccatgtcctatgaccgctatgtggccatctgcaaacctctgcattacaccaccatcatgagcagcagaatctgcatccagctgattttctgctcttggctgggtgggctaatggctattataccaacaatcaccctgatgagtcagcaggacttttgtgcatccaacagactgaatcattacttctgtgactatgagcctcttctggaactctcatgttcagacacaagcctcatagagaaggttgtctttcttgtggcatctgtgaccctggtggtcactctggtgctagtgattctctcctatgcattcattatcaagactattctgaagctcccctctgcccaacaaaggacaaaagccttttccacatgttcttcccacatgattgtcatctccctctcttacggaagctgcatgtttatgtacattaatccctctgcaaaagaaggggatacattcaacaagggagtagctctactcattacttcagttgctcctttgttgaacccctttatttacaccctaaggaaccaacaggtaaaacaacccttcaaggatatggtcaaaaagcttctgaatctttaa

SEQ ID NO: 162089 - DNA, 1042 bp, Homo sapiens
  Payload ID: 11721
  Gene Symbol: OR2AT4
  Gene Name: olfactory receptor, family 2, subfamily AT, member 4
  Uniprot ID: A6NND4
  ENST ID: ENST00000305159
  CDS Start-End: 42-1004
ttccagctgcccatctctgagaaatccagctgtgtctcacaatggatgccacagcctgtaatgaatcagtggatggctcacccgtcttctatctattgggcatcccctctctgccagagaccttcttcctccctgtgttttttattttcctcctcttctaccttctcatcctgatgggtaatgccctgatcctggtggccgtggtggcagagcccagcctccacaagcccatgtacttctttctgatcaatctctccaccttggacatccttttcaccacaaccactgtccccaagatgctgtccttattcttgcttggggaccgcttcctcagcttttcttcctgcttactgcagatgtacctcttccaaagttttacatgttcagaagccttcatcctggtggtcatggcctatgaccgctatgtggctatctgccacccactgcactaccctgtcctcatgaacccacagaccaatgctaccttggcagccagtgcctggctaactgccctcctcctgcccatcccagcagtagtaaggacctcccagatggcatataacagcattgcctacatctaccactgcttctgtgatcatctggctgtggtccaggcctcctgctctgacaccaccccccagaccctcatgggcttctgcatcgccatggtggtgtccttcctcccccttctcctggtgcttctctcctatgtccacatcctggcctcagtgcttcgcatcagttccctagaaggacgggcaaaagccttctccacctgcagctcccaccttctggtcgtgggcacctactactcatctattgccatagcctacgtggcctacagggctgacctgccccttgacttccatatcatgggcaatgtggtatatgccattctcacaccaattctcaaccccctcatttacacgctgagaaacagggatgtaaaggcagccatcaccaaaatcatgtctcaagacccaggctgtgacaggagcatttgacctttaaatgcagctaactctgcttccaggacaccaaa

SEQ ID NO: 162090 - DNA, 954 bp, Homo sapiens
  Payload ID: 11722
  Gene Symbol: OR2B11
  Gene Name: olfactory receptor, family 2, subfamily B, member 11
  Uniprot ID: Q5JQS5
  ENST ID: ENST00000318749
  CDS Start-End: 1-954
atgaaaagtgacaaccatagcttcttaggggactcccctaaagccttcatccttctgggtgtgtctgacaggccgtggctggaactccctctctttgtggtcctcctgctgtcctatgtgctggccatgttggggaacgtcgccatcatcctggcatcccgggtggatcctcaactccacagccccatgtacatcttcctcagtcacctgtccttcctggacctctgctacaccaccacgacagtccctcagatgctggtcaacatgggcagttcccagaagaccatcagctatggaggctgcactgtgcaatatgcagtcttccactggctgggatgcacggagtgcatcgtcctggccgccatggccctggaccgctacgtggccatctgcaagcccctgcactatgccgttctcatgcaccgtgctctctgtcagcagctcgtggctctggcctggctcagtggcttcggcaactccttcgtgcaggtggtcctgacggtgcaattgccattctgcgggcggcaggtgctgaacaactttttctgtgaggtgccggccgtgatcaagctgtcgtgtgctgacaccgctgtgaatgacaccatactggctgtgctggtggccttcttcgtgttggtgcccctggctctcatccttctctcctatggctttattgcccgggcagtgctcaggatccagtcctccaagggacgacacaaggcctttgggacgtgttcctcccacctgatgatcgtctccctcttctacctacctgcgatttacatgtatctgcagcccccttccagctactcccaagagcagggcaaatttatttctctcttctattccataatcacccccactctcaatcccttcacctacaccctgagaaataaagatatgaagggggctctgaggagacttctggccaggatctggaggctctgtggatga

SEQ ID NO: 162091 - DNA, 1212 bp, Homo sapiens
  Payload ID: 11723
  Gene Symbol: OR2B2
  Gene Name: olfactory receptor, family 2, subfamily B, member 2
  Uniprot ID: Q9GZK3
  ENST ID: ENST00000303324
  CDS Start-End: 78-1151
gctgacaaaatcaggaagtgtgttgttaacttcctgacttcttatatttcagagaacgaagagttgaaccatttaacatgaattgggtaaataagagtgtcccacaggagttcattctgttagttttctcagatcaaccatggctagagattccaccctttgtgatgtttctgttttcctatatcttgacaatctttggcaatctgacaataattcttgtgtcacatgtggatttcaaactccacacccctatgtacttttttcttagcaatctctcactcctggacctttgctataccacaagtacagttccacaaatgctggtaaacatatgcaacaccaggaaagtaatcagttatggtggctgtgtggcccagcttttcattttcctggccttgggttccacagaatgtcttctcctggccgtcatgtgctttgataggtttgtagctatttgtcggcctctccattactcaattatcatgcaccagaggctctgcttccagttggcagctgcatcctggattagtggctttagcaattcagtattacagtccacctggacacttaagatgccactgtgtggtcacaaagaagtggatcacttcttctgtgaagtccctgctctgctcaagttgtcctgtgttgacacaacagcaaatgaggctgaactattcttcatcagtgtgctattccttctaatacccgtgacactcatccttatatcgtatgcttttattgtccaagcagtgttgagaatccagtctgctgaaggtcaacgaaaggcatttgggacatgtggctcccatctaattgtggtgtcacttttttatggtacagctatctccatgtacctgcaaccaccttcacccagctccaaagaccggggaaagatggtttctctcttctgtggaatcattgcacccatgctgaatccccttatatatacacttaggaacaaagaggtaaaggaagcctttaaaaggttggttgcaaagagtcttcttaatcaagaaataagaaatatgcaaatgataagctttgctaaagacacagtgcttacttaccttactaacttctccgcaagttgtcctatttttgtcattactatagaaaactattgtaatctccctcaaagaaaatttccttgacaaaaagctatatttgtttctgttgcctaaacattttcattgaacaagcccccagaattgg

SEQ ID NO: 162092 - DNA, 1007 bp, Homo sapiens
  Payload ID: 11724
  Gene Symbol: OR2B3
  Gene Name: olfactory receptor, family 2, subfamily B, member 3
  Uniprot ID: O76000
  ENST ID: ENST00000377173
  CDS Start-End: 66-1007
ataaacaaacattgattgctttcctatcttacatttttttaggagtgcgaaataagtgagtcatcatgaattgggaaaatgagagctccccaaaagagtttatactacttggcttctcagatagggcttggctacaaatgcccctttttgtggtcctgttaatatcatacacaatcaccatatttggcaatgtgtccatcatgatggtgtgcattctggatcccaaacttcatactcccatgtatttctttctcactaatctctccatcttagatctctgctataccacaactacagtccctcatatgttggtaaatattggttgcaacaaaaagaccatcagctatgctggctgtgtggcccacctcatcatcttcctggccctaggtgctacagagtgtctccttctggctgttatgtcctttgacagatatgtggctgtttgcagacccctccactatgtagtcatcatgaattattggttctgcctaaggatggcagccttctcatggctcattggtttcggcaactcagtgctgcagtcttccttgactcttaacatgccacgctgtggtcaccaggaagtggaccactttttctgtgaggtgcctgcacttctcaagttgtcatgtgctgacacaaagcctattgaggctgagctcttcttctttagtgtactaattcttctaattccagtgacattgatcctcatctcctatggcttcatagctcaagcagtattaaaaatcaggtcagcagaaggacggcaaaaagcatttgggacatgtgggtcccacatgattgtggtgtccctcttttatggaacagccatttatatgtatcttcaaccaccttcatccacctctaaggactggggaaagatggtttccctcttctatggaatcatcacatccatgttgaactccctcatctacagccttagaaataaagatatgaaggaggccttcaagaggctgatgccaagaatctttttctgtaagaaataa

SEQ ID NO: 162093 - DNA, 1106 bp, Homo sapiens
  Payload ID: 11724
  Gene Symbol: OR2B3
  Gene Name: olfactory receptor, family 2, subfamily B, member 3
  Uniprot ID: O76000
  ENST ID: ENST00000383653
  CDS Start-End: 66-1007
ataaacaaacattgattgctttcctatcttacatttttttaggagtgcgaaataagtgagtcatcatgaattgggaaaatgagagctccccaaaagagtttatactacttggcttctcagatagggcttggctacaaatgcccctttttgtggtcctgttaatatcatacacaatcaccatatttggcaatgtgtccatcatgatggtgtgcattctggatcccaaacttcatactcccatgtatttctttctcactaatctctccatcttagatctctgctataccacaactacagtccctcatatgttggtaaatattggttgcaacaaaaagaccatcagctatgctggctgtgtggcccacctcatcatcttcctggccctaggtgctacagagtgtctccttctggctgttatgtcctttgacagatatgtggctgtttgcagacccctccactatgtagtcatcatgaattattggttctgcctaaggatggcagccttctcatggctcattggtttcggcaactcagtgctgcagtcttccttgactcttaacatgccacgctgtggtcaccaggaagtggaccactttttctgtgaggtgcctgcacttctcaagttgtcatgtgctgacacaaagcctattgaggctgagctcttcttctttagtgtactaattcttctaattccagtgacattgatcctcatctcctatggcttcatagctcaagcagtattaaaaatcaggtcagcagaaggacggcaaaaagcatttgggacatgtgggtcccacatgattgtggtgtccctcttttatggaacagccatttatatgtatcttcaaccaccttcatccacctctaaggactggggaaagatggtttccctcttctatggaatcatcacatccatgttgaactccctcatctacagccttagaaataaagatatgaaggaggccttcaagaggctgatgccaagaatctttttctgtaagaaataagaagtactccattgtgatgagaatcttcttagtctttccttatcttcaatgatggtaatgacctttgaactcattttcctattttccaggctctggtga

SEQ ID NO: 162094 - DNA, 1007 bp, Homo sapiens; identical to SEQ ID NO: 162092
  Payload ID: 11724
  Gene Symbol: OR2B3
  Gene Name: olfactory receptor, family 2, subfamily B, member 3
  Uniprot ID: O76000
  ENST ID: ENST00000420178
  CDS Start-End: 66-1007

SEQ ID NO: 162095 - DNA, 1007 bp, Homo sapiens; identical to SEQ ID NO: 162092
  Payload ID: 11724
  Gene Symbol: OR2B3
  Gene Name: olfactory receptor, family 2, subfamily B, member 3
  Uniprot ID: O76000
  ENST ID: ENST00000444830
  CDS Start-End: 66-1007

SEQ ID NO: 162096 - DNA, 1007 bp, Homo sapiens; identical to SEQ ID NO: 162092
  Payload ID: 11724
  Gene Symbol: OR2B3
  Gene Name: olfactory receptor, family 2, subfamily B, member 3
  Uniprot ID: O76000
  ENST ID: ENST00000415976
  CDS Start-End: 66-1007

SEQ ID NO: 162097 - DNA, 1007 bp, Homo sapiens; identical to SEQ ID NO: 162092
  Payload ID: 11724
  Gene Symbol: OR2B3
  Gene Name: olfactory receptor, family 2, subfamily B, member 3
  Uniprot ID: O76000
  ENST ID: ENST00000419873
  CDS Start-End: 66-1007

SEQ ID NO: 162098 - DNA, 1007 bp, Homo sapiens; identical to SEQ ID NO: 162092
  Payload ID: 11724
  Gene Symbol: OR2B3
  Gene Name: olfactory receptor, family 2, subfamily B, member 3
  Uniprot ID: O76000
  ENST ID: ENST00000450817
  CDS Start-End: 66-1007

SEQ ID NO: 162099 - DNA, 1007 bp, Homo sapiens; identical to SEQ ID NO: 162092
  Payload ID: 11724
  Gene Symbol: OR2B3
  Gene Name: olfactory receptor, family 2, subfamily B, member 3
  Uniprot ID: O76000
  ENST ID: ENST00000456140
  CDS Start-End: 66-1007

SEQ ID NO: 162100 - DNA, 942 bp, Homo sapiens
  Payload ID: 11725
  Gene Symbol: OR2B6
  Gene Name: olfactory receptor, family 2, subfamily B, member 6
  Uniprot ID: P58173
  ENST ID: ENST00000244623
  CDS Start-End: 1-942
atgaattgggtaaatgacagcatcatacaggagtttattctgctgggtttctcagatcgaccttggctggagtttccactccttgtggtcttcttgatttcttacactgtgaccatctttggcaatctgaccattattctagtgtcacgcctggacaccaaacttcatacccccatgtatttttttcttaccaatctatcactcctggatctttgttacaccacatgtacagtcccacaaatgctagtaaatttatgcagcatcaggaaagtaatcagttatcgtggctgtgtagcccagcttttcatatttctggccttgggggctactgaatatcttctcctggccgtcatgtcctttgataggtttgtagctatttgtcggcctctccattactcagttatcatgcaccagagactctgcctccagttggcagctgcatcctgggttactggttttagtaactcagtgtggttgtctaccctgactctccagctgccactctgtgacccctatgtgatagatcactttctctgtgaagtccctgcactgctcaagttatcttgtgttgagacaacagcaaatgaggctgaactattccttgtcagtgagctcttccatctaatacccctgacactcatccttatatcatatgcttttattgtccgagcagtattgaggatacagtctgctgaaggtcgacaaaaagcatttgggacatgtggttcccatctaattgtggtgtctcttttttatagtacagccgtctctgtgtacctgcaaccaccttcgcccagctccaaggaccaaggaaagatggtttctctcttctatggaatcattgcacccatgctgaatccccttatatatacacttaggaacaaggaggtaaaggaaggctttaaaaggttggttgcaagagtcttcttaatcaagaaataa

SEQ ID NO: 162101 - DNA, 1406 bp, Homo sapiens
  Payload ID: 11726
  Gene Symbol: OR2C1
  Gene Name: olfactory receptor, family 2, subfamily C, member 1
  Uniprot ID: O95371
  ENST ID: ENST00000304936
  CDS Start-End: 53-991
ttccagcagcttgcgctaaatgaattcatcaagtgactgaagacaaccagtgatggacggggtgaatgatagctccttgcagggctttgttctgatgggcatatcagaccatccccagctggagatgatcttttttatagccatcctcttctcctatttgctgaccctacttgggaactcaaccatcatcttgctttcccgcctggaggcccggctccatacacccatgtacttcttcctcagcaacctctcctccttggaccttgctttcgctactagttcagtcccccaaatgctgatcaatttatggggaccaggcaagaccatcagctatggtggctgcataacccagctctatgtcttcctttggctgggggccaccgagtgcatcctgctggtggtgatggcatttgaccgctacgtggcagtgtgccggcccctccgctacaccgccatcatgaacccccagctctgctggctgctggctgtgattgcctgcctgggtggcttgggcaactctgtgatccagtcaacattcactctgcagctcccattgtgtgggcaccggagggtggagggattcctctgcgaggtgcctgccatgatcaaactggcctgtggcgacacaagtctcaaccaggctgtgctcaatggtgtctgcaccttcttcactgcagtcccactaagcatcatcgtgatctcctactgcctcattgctcaggcagtgctgaaaatccgctctgcagaggggaggcgaaaggcgttcaatacgtgcctctcccatctgctggtggtgttcctcttctatggctcagccagctatgggtatctgcttccggccaagaacagcaaacaggaccagggcaagttcatttccctgttctactcgttggtcacacccatggtgaatcccctcatctacacgctgcggaacatggaagtgaagggcgcactgaggaggttgctggggaaaggaagagaagttggctgagagaacactccttcgttatttattgcgtcttcatctctacatgcgtttctcattaactctctctggccaggtgaacatgaggaatactaattccggtaaaaccaaggcatgttcctgacagccctaagctgacagccctaagctgttgggaacatggttagtgttattcgtaatgttctacacttatttaccaaaaatcctactgtggactaccgatagcaggggagacatgttgttgagggctcagaggttattgacctgtgacagacctgtctcactgtctctgtctctgttgcccacatgttatttaatatgccttatatttctgcagaattctgtacttttctaagcaaagcacctccacttgcagtatcttacataatgttactataattccataaaatcaagccatgta

SEQ ID NO: 162102 - DNA, 2742 bp, Homo sapiens
  Payload ID: 11727
  Gene Symbol: OR2C3
  Gene Name: olfactory receptor, family 2, subfamily C, member 3
  Uniprot ID: Q8N628
  ENST ID: ENST00000366487
  CDS Start-End: 363-1325
cagaaatcaactgacaaatggcagattcataggagaaaagacatacacatttatttgatcatagttttacataacagaggagccttcagatgagaatccaaagatacaagagaaacttcccatttttatgcttaggttcaaagccatatggacagccatgtagaaatatgattgaacatgaagggcatgatctaatactgatggactgagtgaagaagcccagcaagacccatcgtgagattctttttggcctctctgagcagtgttccttttttcttggtatgcaataagacctctctggaatggaggtcttatgatctacaatccagtaaggtggccttttgccccacccccagcatacaatgatggaaatagccaatgtgagttctccagaagtctttgtcctcctgggcttctccacacgaccctcactagaaactgtcctcttcatagttgtcttgagtttttacatggtatcgatcttgggcaatggcatcatcattctggtctcccatacagatgtgcacctccacacacctatgtacttctttcttgccaacctccccttcctggacatgagcttcaccacgagcattgtcccacagctcctggctaacctctggggaccacagaaaaccataagctatggagggtgtgtggtccagttctatatctcccattggctgggggcaaccgagtgtgtcctgctggccaccatgtcctatgaccgctacgctgccatctgcaggccactccattacactgtcattatgcatccacagctttgccttgggctagctttggcctcctggctggggggtctgaccaccagcatggtgggctccacgctcaccatgctcctaccgctgtgtgggaacaattgcatcgaccacttcttttgcgagatgcccctcattatgcaactggcttgtgtggataccagcctcaatgagatggagatgtacctggccagctttgtctttgttgtcctgcctctggggctcatcctggtctcttacggccacattgcccgggccgtgttgaagatcaggtcagcagaagggcggagaaaggcattcaacacctgttcttcccacgtggctgtggtgtctctgttttacgggagcatcatcttcatgtatctccagccagccaagagcacctcccatgagcagggcaagttcatagctctgttctacaccgtagtcactcctgcgctgaacccacttatttacaccctgaggaacacggaggtgaagagcgccctccggcacatggtattagagaactgctgtggctctgcaggcaagctggcgcaaatttagagactccagtgccttctgagaaggaagatcaagtttacatcgagcaaagtgaccttggaagacagggcacttgggatgtcgtttttcttctaatattgtttgagctcaaggtagatggaaatctgaaaggagtgtgctcatgccatttccagaccaagaaaatacatttattatttgctaattatcatagttttgttcaattgcgttgttggtttttgctatatatacacatgttgactgtcatcttgttttgtaaactccttgcgttgttgttcagctgttcctcagtatccgaagcgggtggattccaggacgctccgtggataataaactttgacgacgctgagagcgcgcggggagaccggagccggcctgttccccagagcccccggagccctcccagccctcaggcctgcgcctggggtgagctgagcccgggactccgccttgcaggctccggaaccctcgctgtggctcccccgctcggcccaggccttgaagccgcggcgaacctcttcctaccctacctcggggacctggtggcagcggcggcctcccccagcctggaccccgccggccgcgggtctcccggcccaaccccaccgacccagaccaagaccgcgccgagccgccgggactcagcgccttcgggtggcggcggtaagcggggaggaaacatggcgccgcccaaatgcgcccggaggccgttaggctgtggagggcgaggaaggcggtccagaggcggccggcaggtccacgtcctgggcgaccgctctgtcgcagttgggcgagacctacctagtcctgacgggtcgtatttccaagacattttcatattctatccattgttttgtgtgcattttattacttctgtatatagaggtaacaacgctaagcttttttgagatgtctgtttcttctagatgttctgaagtacctgatacatgttaaaattagaggtagtaaaatgacacattttgtaaataactttttgttaaaattcataggaaatgttattttgtgggggggggatggcatggtgtttgtggactggttcagggaaggaggggaaaagggaggtgcagagagctctaagccagtgtgcttacagtgaggcgagattcaccattgtttcttatgattgtgcattttgttttacttatctatgtatacagtgtatctaaaggacaaacgagtcctaatttacaacagctagtctttccagatgttaaagaacttctatcaatagagtaacctatcactagagttcacctctatcaatagagtaacctcattctctgcctgatgattcaaaggcatgggaagaccaaaaccatgtggcagttcctgtttttgattttattatatatatgtatataatatgaaagtagtcattaaagtagtctttcctttcgta

SEQ ID NO: 162103 - DNA, 2481 bp, Homo sapiens
  Payload ID: 11727
  Gene Symbol: OR2C3
  Gene Name: olfactory receptor, family 2, subfamily C, member 3
  Uniprot ID: Q8N628
  ENST ID: ENST00000617752
  CDS Start-End: 103-1065
cacttttaatgtttgctaactgatgtaattgcttcatgtctcatgccctgtatgccctgtgctcttcccacaggtggccttttgccccacccccagcatacaatgatggaaatagccaatgtgagttctccagaagtctttgtcctcctgggcttctccacacgaccctcactagaaactgtcctcttcatagttgtcttgagtttttacatggtatcgatcttgggcaatggcatcatcattctggtctcccatacagatgtgcacctccacacacctatgtacttctttcttgccaacctccccttcctggacatgagcttcaccacgagcattgtcccacagctcctggctaacctctggggaccacagaaaaccataagctatggagggtgtgtggtccagttctatatctcccattggctgggggcaaccgagtgtgtcctgctggccaccatgtcctatgaccgctacgctgccatctgcaggccactccattacactgtcattatgcatccacagctttgccttgggctagctttggcctcctggctggggggtctgaccaccagcatggtgggctccacgctcaccatgctcctaccgctgtgtgggaacaattgcatcgaccacttcttttgcgagatgcccctcattatgcaactggcttgtgtggataccagcctcaatgagatggagatgtacctggccagctttgtctttgttgtcctgcctctggggctcatcctggtctcttacggccacattgcccgggccgtgttgaagatcaggtcagcagaagggcggagaaaggcattcaacacctgttcttcccacgtggctgtggtgtctctgttttacgggagcatcatcttcatgtatctccagccagccaagagcacctcccatgagcagggcaagttcatagctctgttctacaccgtagtcactcctgcgctgaacccacttatttacaccctgaggaacacggaggtgaagagcgccctccggcacatggtattagagaactgctgtggctctgcaggcaagctggcgcaaatttagagactccagtgccttctgagaaggaagatcaagtttacatcgagcaaagtgaccttggaagacagggcacttgggatgtcgtttttcttctaatattgtttgagctcaaggtagatggaaatctgaaaggagtgtgctcatgccatttccagaccaagaaaatacatttattatttgctaattatcatagttttgttcaattgcgttgttggtttttgctatatatacacatgttgactgtcatcttgttttgtaaactccttgcgttgttgttcagctgttcctcagtatccgaagcgggtggattccaggacgctccgtggataataaactttgacgacgctgagagcgcgcggggagaccggagccggcctgttccccagagcccccggagccctcccagccctcaggcctgcgcctggggtgagctgagcccgggactccgccttgcaggctccggaaccctcgctgtggctcccccgctcggcccaggccttgaagccgcggcgaacctcttcctaccctacctcggggacctggtggcagcggcggcctcccccagcctggaccccgccggccgcgggtctcccggcccaaccccaccgacccagaccaagaccgcgccgagccgccgggactcagcgccttcgggtggcggcggtaagcggggaggaaacatggcgccgcccaaatgcgcccggaggccgttaggctgtggagggcgaggaaggcggtccagaggcggccggcaggtccacgtcctgggcgaccgctctgtcgcagttgggcgagacctacctagtcctgacgggtcgtatttccaagacattttcatattctatccattgttttgtgtgcattttattacttctgtatatagaggtaacaacgctaagcttttttgagatgtctgtttcttctagatgttctgaagtacctgatacatgttaaaattagaggtagtaaaatgacacattttgtaaataactttttgttaaaattcataggaaatgttattttgtgggggggggatggcatggtgtttgtggactggttcagggaaggaggggaaaagggaggtgcagagagctctaagccagtgtgcttacagtgaggcgagattcaccattgtttcttatgattgtgcattttgttttacttatctatgtatacagtgtatctaaaggacaaacgagtcctaatttacaacagctagtctttccagatgttaaagaacttctatcaatagagtaacctatcactagagttcacctctatcaatagagtaacctcattctctgcctgatgattcaaaggcatgggaagaccaaaaccatgtggcagttcctgtttttgattttattatatatatgtatataatatgaaagtagtcattaaagtagtctttcctttcgt

SEQ ID NO: 162104 - DNA, 1110 bp, Homo sapiens
  Payload ID: 11728
  Gene Symbol: OR2D2
  Gene Name: olfactory receptor, family 2, subfamily D, member 2
  Uniprot ID: Q9H210
  ENST ID: ENST00000299459
  CDS Start-End: 100-1026
ggcagttcctaagcctgcacttctgaattatataattttataggtatgcctgtctatggttagcacatagtgacttcttactgaaaaggacaacaaactatgagacagataaatcagacacaagtgacagaattcctccttctgggactctctgatgggccacacaccgagcagctgctatttatcgtattattgggtgtctacctggtcactgtgcttggaaatctgcttctaatctcccttgttcatgttgactcccaacttcacacacccatgtatttttttctctgcaacttgtctctggctgacctctgtttctctaccaacatagttcctcaggcactagtccacctgctttccagaaagaaggtcattgcattcacactttgcgcagctcgacttctctttttcctcatttttgggtgtacccagtgcgcccttcttgcagtgatgtcctatgatcgctatgttgcaatctgcaatcctctgcgttaccctaacatcatgacctggaaagtgtgtgtccagctggcaacaggatcatggaccagtggcattctggtgtctgtggtagacaccaccttcatactgaggctaccctaccgaggcagtaacagcattgctcatttcttttgtgaggcccctgcactattgatcttagcatccacagacacccatgcatcagagatggccatttttcttatgggggttgtgattctcctcatacctgtttttctgattctggtatcctatggccgtatcatagtaactgtggtcaagatgaagtcaactgtggggagtctcaaggcattttctacctgtggctcccacctcatggtggtcatacttttttatggatcagcaattatcacttacatgacacccaagtcttccaaacagcaggaaaaatcggtgtctgttttctatgcaatagtgactcccatgcttaatcccctcatctatagcctgagaaacaaggatgtgaaggcagctctgaggaaagtagccacaaggaatttcccatgaaggcttggaatctcacactgacagtgagctcagagaaccttttggcttcctacttcaaagacttgctgggaagacatggaatca

SEQ ID NO: 162105 - DNA, 1070 bp, Homo sapiens
  Payload ID: 11729
  Gene Symbol: OR2D3
  Gene Name: olfactory receptor, family 2, subfamily D, member 3
  Uniprot ID: Q8NGH3
  ENST ID: ENST00000317834
  CDS Start-End: 29-1021
caagacttgatgtcacagacccaaaaaaatgtgttcttttttcttgtgccaaacaggtaaacaggcaaaaatatcaatgggagaagaaaaccaaacctttgtgtccaagtttatcttcctgggtctttcacaggacttgcagacccagatcctgctatttatccttttcctcatcatttatctgctgaccgtgcttggaaaccagctcatcatcattctcatcttcctggattctcgccttcacactcccatgtatttttttcttagaaatctctcctttgcagatctctgtttctctactagcattgtccctcaagtgttggttcacttcttggtaaagaggaaaaccatttctttttatgggtgtatgacacagataattgtctttcttctggttgggtgtacagagtgtgcgctgctggcagtgatgtcctatgaccggtatgtggctgtctgcaagcccctgtactactctaccatcatgacacaacgggtgtgtctctggctgtccttcaggtcctgggccagtggggcactagtgtctttagtagataccagctttactttccatcttccctactggggacagaatataatcaatcactacttttgtgaacctcctgccctcctgaagctggcttccatagacacttacagcacagaaatggccatcttttcaatgggcgtggtaatcctcctggcccctgtctccctgattcttggttcttattggaatattatctccactgttatccagatgcagtctggggaagggagactcaaggctttttccacctgtggctcccatcttattgttgttgtcctcttctatgggtcaggaatattcacctacatgcgaccaaactccaagactacaaaagaactggataaaatgatatctgtgttctatacagcggtgactccaatgttgaaccccataatttatagcttgaggaacaaagatgtcaaaggggctctcaggaaactagttgggagaaagtgcttctctcataggcagtgacctctgagtctgacttttagagctatggcaacattctttaaaaaggagc

SEQ ID NO: 162106 - DNA, 1084 bp, Homo sapiens
  Payload ID: 11730
  Gene Symbol: OR2F1
  Gene Name: olfactory receptor, family 2, subfamily F, member 1 (gene/pseudogene)
  Uniprot ID: Q13607
  ENST ID: ENST00000392899
  CDS Start-End: 40-993
ctgactcccttcacagattaataatccttgaatattttaatgggaacagataaccagacttgggtgagtgaatttattctcctcggcctgtccagtgactgggacactcgggtctccctgtttgtcctgttcttggtcatgtatgtggtgaccgtgctggggaactgtctcattgtccttctgatcagactggacagccgactccacactcccatgtatttctttctcaccaacctctcccttgtcgatgtctcctatgccacaagtgtagtccctcagctgctggcacattttcttgcagaacataaagccatcccattccagagctgtgcagcccagttatttttctccctggccttgggtgggattgagtttgttctcctggcggtgatggcctatgaccgctatgtggctgtgtgtgatgccctgcgatactcggccatcatgcatggagggctgtgtgctaggttggccatcacatcctgggtcagtggcttcatcagctctcctgtgcagactgctatcacctttcagctgcccatgtgcagaaacaagtttattgatcacatatcctgtgaactcctagctgtggtcaggctggcttgtgtggacacctcctccaatgaggtcaccatcatggtgtctagcattgttcttctgatgacacccttctgcctggttcttttgtcctacatccagatcatctccaccatcctaaagatccagtccagagaaggaagaaagaaagctttccacacgtgtgcctctcacctcacagtggttgccctgtgctatggtgtggccattttcacttacatccagccccactccagtccctctgtccttcaggagaagttgttctctgtcttttatgccattttaacaccaatgctgaaccccatgatttacagcctaaggaataaagaggtgaagggggcctggcagaaactattatggaaattctctgggttaacatcaaagctggcaacttgactcatgagtatgacttagagaaaacagctttgcctcagtgttctccacccagctgagatctgacaggtgtaaactacattgccctggcaac

SEQ ID NO: 162107 - DNA, 1089 bp, Homo sapiens
  Payload ID: 11730
  Gene Symbol: OR2F1
  Gene Name: olfactory receptor, family 2, subfamily F, member 1 (gene/pseudogene)
  Uniprot ID: Q13607
  ENST ID: ENST00000624504
  CDS Start-End: 45-998
tttttctgactcccttcacagattaataatccttgaatattttaatgggaacagataaccagacttgggtgagtgaatttattctcctcggcctgtccagtgactgggacactcgggtctccctgtttgtcctgttcttggtcatgtatgtggtgaccgtgctggggaactgtctcattgtccttctgatcagactggacagccgactccacactcccatgtatttctttctcaccaacctctcccttgtcgatgtctcctatgccacaagtgtagtccctcagctgctggcacattttcttgcagaacataaagccatcccattccagagctgtgcagcccagttatttttctccctggccttgggtgggattgagtttgttctcctggcggtgatggcctatgaccgctatgtggctgtgtgtgatgccctgcgatactcggccatcatgcatggagggctgtgtgctaggttggccatcacatcctgggtcagtggcttcatcagctctcctgtgcagactgctatcacctttcagctgcccatgtgcagaaacaagtttattgatcacatatcctgtgaactcctagctgtggtcaggctggcttgtgtggacacctcctccaatgaggtcaccatcatggtgtctagcattgttcttctgatgacacccttctgcctggttcttttgtcctacatccagatcatctccaccatcctaaagatccagtccagagaaggaagaaagaaagctttccacacgtgtgcctctcacctcacagtggttgccctgtgctatggtgtggccattttcacttacatccagccccactccagtccctctgtccttcaggagaagttgttctctgtcttttatgccattttaacaccaatgctgaaccccatgatttacagcctaaggaataaagaggtgaagggggcctggcagaaactattatggaaattctctgggttaacatcaaagctggcaacttgactcatgagtatgacttagagaaaacagctttgcctcagtgttctccacccagctgagatctgacaggtgtaaactacattgccctggcaac

SEQ ID NO: 162108 - DNA, 1114 bp, Homo sapiens
  Payload ID: 11731
  Gene Symbol: OR2F2
  Gene Name: olfactory receptor, family 2, subfamily F, member 2
  Uniprot ID: O95006
  ENST ID: ENST00000408955
  CDS Start-End: 68-1021
tctttgattcaacagcttctgtttttttctgactctttctacagattaatattcctcacatttttaaatggaaatagataaccagacgtgggtgagagaatttattctccttggcttatccagtgactggtgcactcagatatccctgttttccctgttcttggtcacatacctcatgacagtgctggggaactgtctcattgtccttctgatcagactggacagccgactccacactcccatgtatttctttctcaccaacctctcccttgtcgatgtctcctatgccacaagcgtagtcccccagctgctggcacattttcttgcagaacataaagccatcccattccagagctgtgcagcccagttatttttctccctggccttgggtgggattgagtttgttctcctggcagtgatggcctatgaccgccatgtggctgtgtctgaccgcctgcgatactcggccatcatgcatggagggctgtgtgctaggttggccatcacatcctgggtcagtggctccatcaactctcttgtgcagactgctatcacctttcagctgcccatgtgcactaacaagtttattgatcacatatcctgtgaactcctagctgtggtcaggctggcttgtgtggacacctcctccaatgaggctgccatcatggtgtctagcattgttcttctgatgacacctttctgcctggttctgttgtcctacatccggatcatctccaccatcctaaagatccagtccagagaaggaagaaagaaagccttccacacgtgtgcctctcacctcacggtggttgccctgtgctacggcacaacgattttcacttacatccagccccactctggtccctcagtccttcaagagaagctgatctctgtcttctatgccattgttatgcctctgctgaaccctgtgatttatagtctaaggaataaagaggtgaagggggcctggcataaactattagagaaattctctgggttaacatccaagctgggaacttgactcatgaacattactttaagaagaagctttgcctcatttttctccacccagctcagatatggcagggataaactatgttgctctggcaaccgg

SEQ ID NO: 162109 - DNA, 954 bp, Homo sapiens
  Payload ID: 11732
  Gene Symbol: OR2G2
  Gene Name: olfactory receptor, family 2, subfamily G, member 2
  Uniprot ID: Q8NGZ5
  ENST ID: ENST00000320065
  CDS Start-End: 1-954
atggggatggtgagacataccaatgagagcaacctagcaggtttcatccttttagggttttctgattatcctcagttacagaaggttctatttgtgctcatattgattctgtatttactaactattttggggaataccaccatcattctggtttctcgtctggaacccaagcttcatatgccgatgtatttcttcctttctcatctctccttcctgtaccgctgcttcaccagcagtgttattccccagctcctggtaaacctgtgggaacccatgaaaactatcgcctatggtggctgtttggttcacctttacaactcccatgccctgggatccactgagtgcgtcctcccggctgtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcatttcatctgcgaggtccctgtgctcatcaagctggcttgtgtgggcaccacgtttaacgaggctgagctttttgtggctagtatccttttccttatagtgcctgtctcattcatcctggtctcctctggctacattgcccacgcagtgttgaggattaagtcagctaccaggagacagaaagcattcgggacctgcttctcccacctgacagtggtcaccatcttttatggaaccatcatcttcatgtatctgcagccagccaagagtagatccagggaccagggcaagtttgtttctctcttctacactgtggtaacccgcatgcttaaccctcttatttataccttgaggatcaaggaggtgaaaggggcattaaagaaagttctagcaaaggctctgggagtaaatattttatga

SEQ ID NO: 162110 - DNA, 930 bp, Homo sapiens
  Payload ID: 11733
  Gene Symbol: OR2G3
  Gene Name: olfactory receptor, family 2, subfamily G, member 3
  Uniprot ID: Q8NGZ4
  ENST ID: ENST00000320002
  CDS Start-End: 1-930
atgggattgggcaatgagagttccctaatggatttcatccttctaggcttctcagaccaccctcgtctggaggctgttctctttgtatttgtccttttcttctacctcctgacccttgtgggaaacttcaccataatcatcatctcatatctggatccccctcttcataccccaatgtacttttttctcagcaacctctctttactggacatctgcttcactactagccttgctcctcagaccttagttaacttgcaaagaccaaagaagacgatcacttacggtggttgtgtggcgcaactctatatttctctggcactgggctccactgaatgtatcctcttggctgacatggccttggatcggtacattgctgtctgcaaacccctccactatgtagtcatcatgaacccacggctttgccaacagctggcatctatctcctggctcagtggtttggctagttccctaatccatgcaacttttaccttgcaattgcctctctgtggcaaccataggctggaccattttatttgcgaagtaccagctcttctcaagttggcttgtgtggacaccactgtcaatgaattggtgctttttgttgttagtgttctgtttgttgtcattccaccagcactcatctccatctcctatggcttcataactcaagctgtgctgaggatcaaatcagtagaggcaaggcacaaagccttcagcacctgctcctcccaccttacagtggtgattatattctatggcaccataatctacgtgtacctgcaacctagtgacagctatgcccaggaccaagggaagtttatctccctcttctacaccatggtgacccccactttaaatcctatcatctatactttaaggaacaaggatatgaaagaggctctgaggaaacttctctcgggaaaattgtga

SEQ ID NO: 162111 - DNA, 951 bp, Homo sapiens
  Payload ID: 11734
  Gene Symbol: OR2G6
  Gene Name: olfactory receptor, family 2, subfamily G, member 6
  Uniprot ID: Q5TZ20
  ENST ID: ENST00000343414
  CDS Start-End: 1-951
atggaggaaaccaacaacagctctgaaaagggatttcttctcctgggattttcagatcagcctcagctagagaggtttctttttgccatcattttgtacttctacgtcttgagccttctggggaacactgccctcatactagtatgttgtctggactccagactccacactccaatgtacttcttcctcagcaacctctcgtgtgtggacatctgctttaccaccagtgttgccccacagttgctggttaccatgaataagaaagacaaaaccatgagctacggtggctgtgtggcccagctctatgtggccatggggttgggctcgtctgagtgtattctcttggccgtcatggcttatgaccgctatgctgctgtctgccggccactgcgctacatagccattatgcaccccaggttctgtgcgtctctggccggtggagcatggctcagcggcctcatcacctccctaattcagtgctccctcactgtgcagctgcccctctgtggtcatcgcacactggatcatattttctgtgaggtgccagtgctcatcaaactggcctgtgtggatacgactttcaacgaggcagaactctttgtggccagtgtagtctttctaattgtcccggtgttactcatcttagtctcctatggctttatcactcaagctgtgttaaggataaaatcagctgcgggccgccaaaaggcctttgggacctgttcgtctcacctggttgtggtcatcattttctatgggaccatcatattcatgtaccttcaaccggccaataggagatccaaaaaccagggaaagtttgtttctcttttctataccatagtcaccccacttttaaaccccattatctacactctgagaaacaaagatgtgaaaggggccttgaggaccctgatactgggtagtgctgctggacaaagccacaaggactag

SEQ ID NO: 162112 - DNA, 2253 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000377132
  CDS Start-End: 710-1660
tcatgtgtctcagcacagtcttttacagcaaaaatgcatgtcacctcctcctaaaggctttccgtggcccacccacccagattcctcctttattgtgcagactctttcctaacccacacctcatcttaatttatttgccttcaattctgggcggcggtgttggggagggtctcaattttcccatgtatttcccagtgtttattgaatacatgaggccatactcttctagtctctctgcttctcatgctaggaactgaaccgaccagcctatactttaaggcttgttatttcactgactaaggaaaggctacttaagagggcaagctcagacatacataatctggagtggatcttccatgggaaaacacgtatataacagaaattattggcaaaactataagtatggtctacagactttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaattctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162113 - DNA, 3021 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000377133
  CDS Start-End: 463-1413
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162114 - DNA, 3024 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000377136
  CDS Start-End: 466-1416
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162115 - DNA, 2253 bp, Homo sapiens; identical to SEQ ID NO: 162112
  Payload ID: 11735
  Gene Symbol: OR2H1
  Gene Name: olfactory receptor, family 2, subfamily H, member 1
  Uniprot ID: Q9GZK4
  ENST ID: ENST00000383550
  CDS Start-End: 710-1660

SEQ ID NO: 162116 - DNA, 2253 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000383644
  CDS Start-End: 710-1660
tcatgtgtctcagcacagtcttttacagcaaaaatgcatgtcacctcctcctaaaggctttccgtggcccacccacccagattcctcctttattgtgcagactctttcctaacccacacctcatcttaatttatttgccttcaattctgggcggcggtgttggggagggtctcaattttcccatgtatttcccagtgtttattgaatacatgaggccatactcttctagtctctctgcttctcatgctaggaactgaaccgaccagcctatactttaaggcttgttatttcactgactaaggaaaggctacttaagagggcaagctcagacatacataatctggagtggatcttccatgggaaaacacgtatataacagaaattattggcaaaactataagtatggtctacagactttctttgccctcaaccaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaattctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162117 - DNA, 1294 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000396792
  CDS Start-End: 331-1281
tgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaa

SEQ ID NO: 162118 - DNA, 1294 bp, Homo sapiens; identical to SEQ ID NO: 162117
  Payload ID: 11735
  Gene Symbol: OR2H1
  Gene Name: olfactory receptor, family 2, subfamily H, member 1
  Uniprot ID: Q9GZK4
  ENST ID: ENST00000400689
  CDS Start-End: 331-1281

SEQ ID NO: 162119 - DNA, 3021 bp, Homo sapiens; identical to SEQ ID NO: 162113
  Payload ID: 11735
  Gene Symbol: OR2H1
  Gene Name: olfactory receptor, family 2, subfamily H, member 1
  Uniprot ID: Q9GZK4
  ENST ID: ENST00000400693
  CDS Start-End: 463-1413

SEQ ID NO: 162120 - DNA, 3024 bp, Homo sapiens; identical to SEQ ID NO: 162114
  Payload ID: 11735
  Gene Symbol: OR2H1
  Gene Name: olfactory receptor, family 2, subfamily H, member 1
  Uniprot ID: Q9GZK4
  ENST ID: ENST00000400694
  CDS Start-End: 466-1416

SEQ ID NO: 162121 - DNA, 1294 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000400712
  CDS Start-End: 331-1281
tgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaa

SEQ ID NO: 162122 - DNA, 3021 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000400713
  CDS Start-End: 463-1413
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggaaccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162123 - DNA, 3024 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000400714
  CDS Start-End: 466-1416
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggaaccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162124 - DNA, 3021 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000436167
  CDS Start-End: 463-1413
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162125 - DNA, 2253 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000446161
  CDS Start-End: 710-1660
tcatgtgtctcagcacagtcttttacagcaaaaatgcatgtcacctcctcctaaaggctttccgtggcccacccacccagattcctcctttattgtgcagactctttcctaacccacacctcatcttaatttatttgccttcaattctgggcggcggtgttggggagggtctcaattttcccatgtatttcccagtgtttattgaatacatgaggccatactcttctagtctctctgcttctcatgctaggaactgaaccgaccagcctatactttaaggcttgttatttcactgactaaggaaaggctacttaagagggcaagctcagacatacataatctggagtggatcttccatgggaaaacacgtatataacagaaattattggcaaaactataagtatggtctacagactttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaattctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162126 - DNA, 3024 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000453467
  CDS Start-End: 466-1416
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162127 - DNA, 1294 bp, Homo sapiens; identical to SEQ ID NO: 162117
  Payload ID: 11735
  Gene Symbol: OR2H1
  Gene Name: olfactory receptor, family 2, subfamily H, member 1
  Uniprot ID: Q9GZK4
  ENST ID: ENST00000431658
  CDS Start-End: 331-1281

SEQ ID NO: 162128 - DNA, 1294 bp, Homo sapiens; identical to SEQ ID NO: 162117
  Payload ID: 11735
  Gene Symbol: OR2H1
  Gene Name: olfactory receptor, family 2, subfamily H, member 1
  Uniprot ID: Q9GZK4
  ENST ID: ENST00000418376
  CDS Start-End: 331-1281

SEQ ID NO: 162129 - DNA, 1294 bp, Homo sapiens; identical to SEQ ID NO: 162121
  Payload ID: 11735
  Gene Symbol: OR2H1
  Gene Name: olfactory receptor, family 2, subfamily H, member 1
  Uniprot ID: Q9GZK4
  ENST ID: ENST00000416582
  CDS Start-End: 331-1281

SEQ ID NO: 162130 - DNA, 3021 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000454071
  CDS Start-End: 463-1413
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162131 - DNA, 2253 bp, Homo sapiens; identical to SEQ ID NO: 162125
  Payload ID: 11735
  Gene Symbol: OR2H1
  Gene Name: olfactory receptor, family 2, subfamily H, member 1
  Uniprot ID: Q9GZK4
  ENST ID: ENST00000440672
  CDS Start-End: 710-1660

SEQ ID NO: 162132 - DNA, 2253 bp, Homo sapiens; identical to SEQ ID NO: 162116
  Payload ID: 11735
  Gene Symbol: OR2H1
  Gene Name: olfactory receptor, family 2, subfamily H, member 1
  Uniprot ID: Q9GZK4
  ENST ID: ENST00000415581
  CDS Start-End: 710-1660

SEQ ID NO: 162133 - DNA, 3024 bp, Homo sapiens; identical to SEQ ID NO: 162126
  Payload ID: 11735
  Gene Symbol: OR2H1
  Gene Name: olfactory receptor, family 2, subfamily H, member 1
  Uniprot ID: Q9GZK4
  ENST ID: ENST00000435958
  CDS Start-End: 466-1416

SEQ ID NO: 162134 - DNA, 3024 bp, Homo sapiens; identical to SEQ ID NO: 162114
  Payload ID: 11735
  Gene Symbol: OR2H1
  Gene Name: olfactory receptor, family 2, subfamily H, member 1
  Uniprot ID: Q9GZK4
  ENST ID: ENST00000443407
  CDS Start-End: 466-1416

SEQ ID NO: 162135 - DNA, 3021 bp, Homo sapiens; identical to SEQ ID NO: 162130
  Payload ID: 11735
  Gene Symbol: OR2H1
  Gene Name: olfactory receptor, family 2, subfamily H, member 1
  Uniprot ID: Q9GZK4
  ENST ID: ENST00000458051
  CDS Start-End: 463-1413

SEQ ID NO: 162136 - DNA, 3021 bp, Homo sapiens; identical to SEQ ID NO: 162113
  Payload ID: 11735
  Gene Symbol: OR2H1
  Gene Name: olfactory receptor, family 2, subfamily H, member 1
  Uniprot ID: Q9GZK4
  ENST ID: ENST00000412956
  CDS Start-End: 463-1413

SEQ ID NO: 162137 - DNA, 3024 bp, Homo sapiens
  Payload ID: 11735
  Gene Symbol: OR2H1
  Gene Name: olfactory receptor, family 2, subfamily H, member 1
  Uniprot ID: Q9GZK4
  ENST ID: ENST00000456657
  CDS Start-End: 466-1416
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 162138 - DNA, 3024 bp, Homo sapiens; identical to SEQ ID NO: 162137
  Payload ID: 11735
  Gene Symbol: OR2H1
  Gene Name: olfactory receptor, family 2, subfamily H, member 1
  Uniprot ID: Q9GZK4
  ENST ID: ENST00000439879
  CDS Start-End: 466-1416

SEQ ID NO: 162139 - DNA, 2253 bp, Homo sapiens; identical to SEQ ID NO: 162112
  Payload ID: 11735
  Gene Symbol: OR2H1
  Gene Name: olfactory receptor, family 2, subfamily H, member 1
  Uniprot ID: Q9GZK4
  ENST ID: ENST00000421808
  CDS Start-End: 710-1660

SEQ ID NO: 162140 - DNA, 1294 bp, Homo sapiens; identical to SEQ ID NO: 162117
  Payload ID: 11735
  Gene Symbol: OR2H1
  Gene Name: olfactory receptor, family 2, subfamily H, member 1
  Uniprot ID: Q9GZK4
  ENST ID: ENST00000444920
  CDS Start-End: 331-1281

SEQ ID NO: 162141 - DNA, 3021 bp, Homo sapiens; identical to SEQ ID NO: 162124
  Payload ID: 11735
  Gene Symbol: OR2H1
  Gene Name: olfactory receptor, family 2, subfamily H, member 1
  Uniprot ID: Q9GZK4
  ENST ID: ENST00000449826
  CDS Start-End: 463-1413

SEQ ID NO: 162142 - DNA, 1294 bp, Homo sapiens; identical to SEQ ID NO: 162121
  Payload ID: 11735
  Gene Symbol: OR2H1
  Gene Name: olfactory receptor, family 2, subfamily H, member 1
  Uniprot ID: Q9GZK4
  ENST ID: ENST00000438840
  CDS Start-End: 331-1281

SEQ ID NO: 162143 - DNA, 2253 bp, Homo sapiens; identical to SEQ ID NO: 162116
  Payload ID: 11735
  Gene Symbol: OR2H1
  Gene Name: olfactory receptor, family 2, subfamily H, member 1
  Uniprot ID: Q9GZK4
  ENST ID: ENST00000440557
  CDS Start-End: 710-1660

SEQ ID NO: 162144 - DNA, 1584 bp, Homo sapiens
  Payload ID: 11736
  Gene Symbol: OR2H2
  Gene Name: olfactory receptor, family 2, subfamily H, member 2
  Uniprot ID: O95918
  ENST ID: ENST00000376947
  CDS Start-End: 491-1429
ttctataaaattcattcaaccaatagagcaataattgagcctacagagacaacttatcagaaaattcattcaatataccttacgagatcatccaatagataagagacaactctagaacagcattcagaacatagtggcactcaataaatttcccctgaatgaatgaattaatgaattagtgcatattttaatcagcctcctttgccctcacccaggaagtcagaggcaccagtgtgagtatccatctgctgtccagtacattcatggattcctcactctcactagacaatgtttgaccaggaagaacagggaatgagaaggagctgctggatggtgatgagccttggaaagggaggctgggcgagcagagacagaagagaaacacctacctgctgtgacctcacaaacacccaggctgagttttgataagacaggttgaatcacactggggtgacagcctcatccctccaggtacaaacaagaacaggccatggttaaccaaagctccacaccgggcttcctccttctgggcttctctgaacacccagggctggaaaggactctcttcgtggttgtcctcacttcctacctcctaaccctagtgggcaacacactcatcatcctgctgtctgcgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttcttcacacccattacattgtgggaatggatgaaagccacatgtctgtgtgtgtgcatgtatgtgtgcaaga

SEQ ID NO: 162145 - DNA, 1584 bp, Homo sapiens
  Payload ID: 11736
  Gene Symbol: OR2H2
  Gene Name: olfactory receptor, family 2, subfamily H, member 2
  Uniprot ID: O95918
  ENST ID: ENST00000383546
  CDS Start-End: 491-1429
ttctataaaattcattcaaccaatagagcaataattgagcctacagagacaacttatcagaaaattcattcaatataccttacgagatcatccaatagataagagacaactctagaacagcattcagaacatagtggcactcaataaatttcccctgaatgaatgaattaatgaattagtgcatattttaatcagcctcctttgccctcacccaggaagtcagaggcaccagtgtgagtatccatctgctgtccagtacattcatggattcctcactctcactagacaatgtttgaccaggaagaacagggaatgagaaggagctgctggatggtgatgagccttggaaagggaggctgggcgagcagagacagaagagaaacacctacctgctgtgacctcacaaacacccaggctgagttttgataagacaggttgaatcacactggggtgacagcctcatccctccaggtacaaacaagaacaggccatggttaaccaaagctccacaccgggcttcctccttctgggcttctctgaacacccagggctggaaaggactctcttcgtggttgtcttcacttcctacctcctaaccctagtgggcaacacactcatcatcctgctgtctgtgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttcttcacacccattacattgtgggaatggatgaaagccacatgtctgtgtgtgtgcatgtatgtgtgcaaga

SEQ ID NO: 162146 - DNA, 1584 bp, Homo sapiens
  Payload ID: 11736
  Gene Symbol: OR2H2
  Gene Name: olfactory receptor, family 2, subfamily H, member 2
  Uniprot ID: O95918
  ENST ID: ENST00000383640
  CDS Start-End: 491-1429
ttctataaaattcattcaaccaatagagcaataattgagcctacagagacaacttatcagaaaattcattcaatataccttacgagatcatccaatagataagagacaactctagaacagcattcagaacatagtggcactcaataaatttcccctgaatgaatgaattaatgaattagtgcatattttaatcagcctcctttgccctcacccaggaagtcagaggcaccagtgtgagtatccatctgctgtccagtacattcatggattcctcactctcactagacaatgtttgaccaggaagaacagggaatgagaaggagctgctggatggtgatgagccttggaaagggaggctgggcgagcagagacagaagagaaacacctacctgctgtgacctcacaaacacccaggctgagttttgataagacaggttgaatcacactggagtgacagcctcatccctccaggtacaaacaagaacaggccatggttaaccaaagctccacaccgggcttcctccttctgggcttctctgaacacccagggctggaaaggactctcttcgtggttgtcctcacttcctacctcctaaccctagtgggcaacacactcatcatcctgctgtctgcgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttcttcacacccattacattgtgggaatggatgaaagccacatgtctgtgtgtgtgcatgtatgtgtgcaaga

SEQ ID NO: 162147 - DNA, 1584 bp, Homo sapiens
  Payload ID: 11736
  Gene Symbol: OR2H2
  Gene Name: olfactory receptor, family 2, subfamily H, member 2
  Uniprot ID: O95918
  ENST ID: ENST00000439874
  CDS Start-End: 491-1429
ttctataaaattcattcaaccaatagagcaataattgagcctacagagacaacttatcagaaaattcattcaatataccttacgagatcatccaatagataagagacaactctagaacagcattcagaacatagtggcactcaataaatttcccctgaatgaatgaattaatgaattagtgcatattttaatcagcctcctttgccctcacccaggaagtcagaggcaccagtgtgagtatccatctgctgtccagtacattcatggattcctcactctcactagacaatgtttgaccaggaagaacagggaatgagaaggagctgctggatggtgatgagccttggaaagggaggctgggcgagcagagacagaagagaaacacctacctgctgtgacctcacaaacacccaggctgagttttgataagacaggttgaatcacactggggtgacagcctcatccctccaggtacaaacaagaacaggccatggttaaccaaagctccacaccgggcttcctccttctgggcttctctgaacacccagggctggaaaggactctcttcgtggttgtcttcacttcctacctcctaaccctagtgggcaacacactcatcatcctgctgtctgcgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttcttcacacccattacattgtgggaatggatgaaagccacatgtctgtgtgtgtgcatgtatgtgtgcaaga

SEQ ID NO: 162148 - DNA, 1584 bp, Homo sapiens; identical to SEQ ID NO: 162145
  Payload ID: 11736
  Gene Symbol: OR2H2
  Gene Name: olfactory receptor, family 2, subfamily H, member 2
  Uniprot ID: O95918
  ENST ID: ENST00000454628
  CDS Start-End: 491-1429

SEQ ID NO: 162149 - DNA, 1584 bp, Homo sapiens; identical to SEQ ID NO: 162144
  Payload ID: 11736
  Gene Symbol: OR2H2
  Gene Name: olfactory receptor, family 2, subfamily H, member 2
  Uniprot ID: O95918
  ENST ID: ENST00000411574
  CDS Start-End: 491-1429

SEQ ID NO: 162150 - DNA, 1584 bp, Homo sapiens
  Payload ID: 11736
  Gene Symbol: OR2H2
  Gene Name: olfactory receptor, family 2, subfamily H, member 2
  Uniprot ID: O95918
  ENST ID: ENST00000453513
  CDS Start-End: 491-1429
ttctataaaattcattcaaccaatagagcaataattgagcctacagagacaacttatcagaaaattcattcaatataccttacgagatcatccaatagataagagacaactctagaacagcattcagaacatagtggcactcaataaatttcccctgaatgaatgaattaatgaattagtgcatattttaatcagcctcctttgccctcacccaggaagtcagaggcaccagtgtgagtatccatctgctgtccagtacattcatggattcctcactctcactagacaatgtttgaccaggaagaacagggaatgagaaggagctgctggatggtgatgagccttggaaagggaggctgggcgagcagagacagaagagaaacacctacctgctgtgacctcacaaacacccaggctgagttttgataagacaggttgaatcacactggggtgacagcctcatccctccaggtacaaacaagaacaggccatggttaaccaaagctccacaccgggcttcctccttctgggcttctctgaacacccagggctggaaaggactctcttcgtggttgtcttcacttcctacctcctaaccctagtgggcaacacactcatcatcctgctgtctgtgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttcttcacacccattatattgtgggaatggatgaaagccacatgtctgtgtgtgtgcatgtatgtgtgcaaga

SEQ ID NO: 162151 - DNA, 1273 bp, Homo sapiens
  Payload ID: 11737
  Gene Symbol: OR2J1
  Gene Name: olfactory receptor, family 2, subfamily J, member 1 (gene/pseudogene)
  Uniprot ID: Q9GZK6
  ENST ID: ENST00000377171
  CDS Start-End: 335-1273
aatcaatttaactttttaaaataaaaaattattttcttaaatattgtctttctgattatggaatatcttagtcttcatttatccaaatgttaactcaaggatgtatataaaagaactcagtaacttgaaaagctattacttgtatccacagctggacaaatatctcaatgaagcatacaaaggaaactgtataaaaattctactgccataatggtgcacactatctggaattgggatacttttttctccaatctgtttgcaagtgagcagttggcaatgcatggacagactttgagtttatgcgattctttctttaggtacaggaaaaataagaatgttgatgaaaaaaaatgcaagttttgaagacttctttcttctacttggattttctaactggcctcatctggaagtagttctctttgtggttatcttgatcttctacttgataacactgataggaaacctgttcatcatcatcctgtcatacctggactcccatctccacactcccatgtacttcttcctttcaaatctctcatttctggatctctgctacaccaccagctctatccctcagttgctggtgaatctctggggcccggaaaagaccatctcttatgctggttgtacggttcaactttactttgttctcgcactgggaaccgcagagtgtgtcctactggtggtgatgtcctatgatcgttatgcagctgtgtgtagacctttgcattacactgtcctcatgcaccctcgtttctgccgcttgttggctgcggcttcttgggtaagtggttttacaacctcagcacttcattcctcctttactttctggatacccctatgtagacatcgcctagtggatcacttcttctgtgaagttccagcacttctgcgattatcatgtgttgatacccaggcaaatgagctgaccctcatggtcatgagctccatatttgttctcatacctctcatcctcatcctcacttcctatggtgccattgcccgggctgtactgagcatgcaatcaaccactgggcttcagaaagtgcttaggacatgtggagcccatcttatggttgtatctctctttttcattccagtcatgtgcatgtatctccagccaccatcagaaaattctcaagatcaaggcaagttcattgccctcttttacactgttgtcacacctagtcttaaccctctaatctacactttcagaaacaaggatgtaagaggggcagtgaagagactaatggggtgggaatgggggatgtga

SEQ ID NO: 162152 - DNA, 1273 bp, Homo sapiens
  Payload ID: 11737
  Gene Symbol: OR2J1
  Gene Name: olfactory receptor, family 2, subfamily J, member 1 (gene/pseudogene)
  Uniprot ID: Q9GZK6
  ENST ID: ENST00000427659
  CDS Start-End: 335-1273
aatcaatttaactttttaaaataaaaaattattttcttaaatattgtctttctgattatggaatatcttagtcttcatttatccaaatgttaactcaaggatgtatataaaagaactcagtaacttgaaaagctattacttgtatccacagctggacaaatatctcaatgaagcatacaaaggaaactgtataaaaattctactgccataatggtgcacattatctggaattgggatacttttttctccaatctgtttgcaagtgagcagttggcaatgcatggacagactttgagtttatgcgattctttctttaggtacaggaaaaataagaatgttgatgaaaaaaaatgcaagttttgaagacttctttattctacttggattttctaactggcctcatctggaagtagttctctttgtggttatcttgatcttctacttgataacactgataggaaacctgttcatcatcatcctgtcatacctggactcccatctccacactcccatgtacttcttcctttcaaatctctcatttctggatctctgctacaccaccagctctatccctcagttgctggtgaatctctggggcccggaaaagaccatctcttatgctggttgtacggttcaactttactttgttctcgcactgggaaccgcagagtgtgtcctactggtggtgatgtcctatgatcgttatgcagctgtgtgtagacctttgcattacactgtcctcatgcaccctcgtttctgccgcttgttggctgcggcttcttgggtaagtggttttacaacctcagcacttcattcctcctttactttctggatacccctatgtagacatcgcctagtggatcacttcttctgtgaagttccagcacttctgcgattatcatgtgttgatacccaggcaaatgagctgaccctcatggtcatgagctccatttttgttctcatacctctcatcctcatcctcacttcctatggtgccattgcccgggctgtactgagcatgcaatcaaccactgggcttcagaaagtgcttaggacatgtggagcccatcttatggttgtatctctctttttcattccagtcatgtgcatgtatctccagccaccatcagaaaattctcaagatcaaggcaagttcattgccctcttttacactgttgtcacacctagtcttaaccctctaatctacactttcagaaacaaggatgtaagaggggcagtgaagagactaatggggtgggaatgggggatgtga

SEQ ID NO: 162153 - DNA, 1272 bp, Homo sapiens
  Payload ID: 11738
  Gene Symbol: OR2J2
  Gene Name: olfactory receptor, family 2, subfamily J, member 2
  Uniprot ID: O76002
  ENST ID: ENST00000358688
  CDS Start-End: 334-1272
aataatttgactttttaaagtaaaaaatcatttttcataaatattgtgttcctgattatggactatcttagtcttcattaatccaaatgttaattcagggatgtatataaagaactcagtaacttgagaagctattgcttgtatctgtagctggataaatatctcaatgaagcacataaagggaactgtataaaaattctactaccattatggtgcacactctctggaagtgggatacttttgtcttcaatctgtttgcaagtgagcggttgacaatgcatggacagactttgagtttatgtggttctttctttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgctacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggttgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctcattctcactacctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 162154 - DNA, 1272 bp, Homo sapiens
  Payload ID: 11738
  Gene Symbol: OR2J2
  Gene Name: olfactory receptor, family 2, subfamily J, member 2
  Uniprot ID: O76002
  ENST ID: ENST00000377167
  CDS Start-End: 334-1272
aataatttgactttttaaagtaaaaaatcatttttcataaatattgtgttcctgattatggactatcttagtcttcattaatccaaatgttaattcagggatgtatataaagaactcagtaacttgagaagctattgcttgtatctgtagctggataaatatctcaatgaagcatataaagggaactgtataaaaattctactaccattatggtgcacactctctggaagtgggatacttttgtcttcaatctgtttgcaagtgagcggttgacaatgcatggacagactttgagtttatgtggttctttctttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgctacaccaccagctctatccctcagttgctggtgaatctccggggcccggaaaagaccatctcgtatgctggttgcatggttcaactttactttgttcttgcactgggaatcacagagtgtgtcctactggtggtgatgtcatatgatcgttatgtagctgtgtgtagacctttgcattacactgtcctcatgcaccctcgtttctgccacttgttggttgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctcattctcactacctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 162155 - DNA, 1272 bp, Homo sapiens
  Payload ID: 11738
  Gene Symbol: OR2J2
  Gene Name: olfactory receptor, family 2, subfamily J, member 2
  Uniprot ID: O76002
  ENST ID: ENST00000415857
  CDS Start-End: 334-1272
aataatttgactttttaaagtaaaaaatcatttttcataaatattgtgttcctgattatggactatcttagtcttcattaatccaaatgttaattcagggatgtatataaagaactcagtaacttgagaagctattgcttgtatctgtagctggataaatatctcaatgaagcatataaagggaactgtataaaaattctactaccattatggtgcacactctctggaagtgggatacttttgtcttcaatctgtttgcaagtgagcggttgacaatgcatggacagactttgagtttatgtggttctttctttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgccacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggctgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctgattctcactgcctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 162156 - DNA, 1272 bp, Homo sapiens
  Payload ID: 11738
  Gene Symbol: OR2J2
  Gene Name: olfactory receptor, family 2, subfamily J, member 2
  Uniprot ID: O76002
  ENST ID: ENST00000411588
  CDS Start-End: 334-1272
aataatttgactttttaaagtaaaaaatcatttttcataaatattgtgttcctgattatggactatcttagtcttcattaatccaaatgttaattcagggatgtatataaagaactcagtaacttgagaagctattgcttgtatctgtagctggataaatatctcaatgaagcatataaagggaactgtataaaaattctactaccattatggtgcacactctctggaagtgggatacttttgtcttcaatctgtttgcaagtgagcggttgacaatgcatggacagactttgagtttatgtggttctttctttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgctacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggttgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctcattctcactacctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 162157 - DNA, 1272 bp, Homo sapiens; identical to SEQ ID NO: 162155
  Payload ID: 11738
  Gene Symbol: OR2J2
  Gene Name: olfactory receptor, family 2, subfamily J, member 2
  Uniprot ID: O76002
  ENST ID: ENST00000440124
  CDS Start-End: 334-1272

SEQ ID NO: 162158 - DNA, 1272 bp, Homo sapiens
  Payload ID: 11738
  Gene Symbol: OR2J2
  Gene Name: olfactory receptor, family 2, subfamily J, member 2
  Uniprot ID: O76002
  ENST ID: ENST00000427744
  CDS Start-End: 334-1272
aataatttgactttttaaagtaaaaaatcatttttcataaatattgtgttcctgattatggactatcttagtcttcattaatccaaatgttaattcagggatgtatataaagaactcagtaacttgagaagctattgcttgtatctgtagctggataaatatctcaatgaagcatataaagggaactgtataaaaattctactaccattatggtgcacactctctggaagtgggatacttttgtcttcaatctgtttgcaagtgagcggttgacaatgcatggacagactttgagtttatgtggttctttttttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgccacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggctgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctgattctcactgcctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 162159 - DNA, 1272 bp, Homo sapiens; identical to SEQ ID NO: 162155
  Payload ID: 11738
  Gene Symbol: OR2J2
  Gene Name: olfactory receptor, family 2, subfamily J, member 2
  Uniprot ID: O76002
  ENST ID: ENST00000419605
  CDS Start-End: 334-1272

SEQ ID NO: 162160 - DNA, 1272 bp, Homo sapiens; identical to SEQ ID NO: 162155
  Payload ID: 11738
  Gene Symbol: OR2J2
  Gene Name: olfactory receptor, family 2, subfamily J, member 2
  Uniprot ID: O76002
  ENST ID: ENST00000457762
  CDS Start-End: 334-1272

SEQ ID NO: 162161 - DNA, 936 bp, Homo sapiens
  Payload ID: 11739
  Gene Symbol: OR2J3
  Gene Name: olfactory receptor, family 2, subfamily J, member 3
  Uniprot ID: O76001
  ENST ID: ENST00000377169
  CDS Start-End: 1-936
atgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccgagctatactgaggatgcagtcaaccactgggcttcagaaagtgtttggaacatgtggagctcatcttatggctgtatctctctttttcattccggccatgtgcatgtatctccagccaccatcaggaaattctcaagatcaaggcaagttcattgccctcttttatactgttgtcacacctagtcttaaccctctaatctacaccctcagaaacaaagttgtaagaggggcagtgaagagactaatggggtgggaatga

SEQ ID NO: 162162 - DNA, 936 bp, Homo sapiens
  Payload ID: 11739
  Gene Symbol: OR2J3
  Gene Name: olfactory receptor, family 2, subfamily J, member 3
  Uniprot ID: O76001
  ENST ID: ENST00000383651
  CDS Start-End: 1-936
atgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccgagctgtactgaggatgcagtcaaccactgggcttcagaaagtgtttggaacatgtggagctcatcttatggctgtatctctctttttcattccggccatgtgcatatatctccagccaccatcaggaaattctcaagatcaaggcaagttcattgccctcttttatactgttgtcacacctagtcttaaccctctaatctacaccctcagaaacaaagttgtaagaggggcagtgaagagactaatggggtgggaatga

SEQ ID NO: 162163 - DNA, 936 bp, Homo sapiens; identical to SEQ ID NO: 162162
  Payload ID: 11739
  Gene Symbol: OR2J3
  Gene Name: olfactory receptor, family 2, subfamily J, member 3
  Uniprot ID: O76001
  ENST ID: ENST00000430478
  CDS Start-End: 1-936

SEQ ID NO: 162164 - DNA, 936 bp, Homo sapiens; identical to SEQ ID NO: 162162
  Payload ID: 11739
  Gene Symbol: OR2J3
  Gene Name: olfactory receptor, family 2, subfamily J, member 3
  Uniprot ID: O76001
  ENST ID: ENST00000428081
  CDS Start-End: 1-936

SEQ ID NO: 162165 - DNA, 936 bp, Homo sapiens; identical to SEQ ID NO: 162162
  Payload ID: 11739
  Gene Symbol: OR2J3
  Gene Name: olfactory receptor, family 2, subfamily J, member 3
  Uniprot ID: O76001
  ENST ID: ENST00000414140
  CDS Start-End: 1-936

SEQ ID NO: 162166 - DNA, 774 bp, Homo sapiens
  Payload ID: 11739
  Gene Symbol: OR2J3
  Gene Name: olfactory receptor, family 2, subfamily J, member 3
  ENST ID: ENST00000422576
  CDS Start-End: 1-774
atgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccaagctgtactgaggatgcagtcaaccactgggcttcagaaagtgtttggaacatgtggagctcatcttatggctgtatctctctttttcattccggcc

SEQ ID NO: 162167 - DNA, 936 bp, Homo sapiens; identical to SEQ ID NO: 162162
  Payload ID: 11739
  Gene Symbol: OR2J3
  Gene Name: olfactory receptor, family 2, subfamily J, member 3
  Uniprot ID: O76001
  ENST ID: ENST00000418630
  CDS Start-End: 1-936

SEQ ID NO: 162168 - DNA, 936 bp, Homo sapiens; identical to SEQ ID NO: 162162
  Payload ID: 11739
  Gene Symbol: OR2J3
  Gene Name: olfactory receptor, family 2, subfamily J, member 3
  Uniprot ID: O76001
  ENST ID: ENST00000419260
  CDS Start-End: 1-936

SEQ ID NO: 162169 - DNA, 1075 bp, Homo sapiens
  Payload ID: 11739
  Gene Symbol: OR2J3
  Gene Name: olfactory receptor, family 2, subfamily J, member 3
  ENST ID: ENST00000621670
  CDS Start-End: 82-1017
catgtgtgctgatatttttggatcatttgtttactcgttttttgagtttacctttcttttttttctctcaggtaataggaaatgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccaagctgtactgaggatgcagtcaaccactgggcttcagaaagtgtttggaacatgtggagctcatcttatggctgtatctctctttttcattccggccatgtgcatgtatctccagccaccatcagggaattctcaagatcaaggcaagttcattgctctcttttatactgttgttacacctagtcttaaccctctaatctacaccctcagaaacaaagatgtaagaggggtagtgaagagactaagggggtgggagtgagcctgtgtttgtgtgatattaacaatataatggagtctttcctcacaatgattcatcc

SEQ ID NO: 162170 - DNA, 951 bp, Homo sapiens
  Payload ID: 11740
  Gene Symbol: OR2K2
  Gene Name: olfactory receptor, family 2, subfamily K, member 2
  ENST ID: ENST00000302681
  CDS Start-End: 1-951
atgcaaggagaaaacttcaccatttggagcatttttttcttggagggattttcccagtacccagggttagaagtggttctcttcgtcttcagccttgtaatgtatctgacaacgctcttgggcaacagcactcttattttgatcactatcctagattcacgccttaaaacccccatgtacttattccttggaaatctctctttcatggatatttgttacacatctgcctctgttcctactttgctggtgaacttgctgtcatcccagaaaaccattatcttttctgggtgtgctgtacagatgtatctgtcccttgccatgggctccacagagtgtgtgctcctggccgtgatggcatatgaccgttatgtggccatttgtaacccgctgagatactccatcatcatgaacaggtgcgtctgtgcacggatggctacggtctcctgggtgacgggttgcctgaccgctctgctggaaaccagttttgccctgcagatacccctctgtgggaatctcatcgatcacttcacgtgtgaaattctggcggtgctaaagttagcttgcacaagttcactgctcatgaacaccatcatgctggtggtcagcattctcctcttgccaattccaatgctcttagtttgcatctcttacatcttcatcctttccactattctgagaatcacctcagcagagggaagaaacaaggctttttctacctgtggtgcccatttgactgtggtgattttgtattatggggctgccctctctatgtacctaaagccttcttcatcaaatgcacaaaaaatagacaaaatcatctcgttgctttacggagtgcttacccctatgttgaaccccataatttacagtttaagaaacaaggaagtcaaagatgctatgaagaaattgctgggcaaaataacattgcatcaaacacacgaacatctctga

SEQ ID NO: 162171 - DNA, 1038 bp, Homo sapiens
  Payload ID: 11740
  Gene Symbol: OR2K2
  Gene Name: olfactory receptor, family 2, subfamily K, member 2
  Uniprot ID: Q8NGT1
  ENST ID: ENST00000374428
  CDS Start-End: 1-1038
atgaatatcacactttattcatttctttatgtcctcagattaaatgaagggaatagtactggaagaaatatagatgaaagaaagaaaatgcaaggagaaaacttcaccatttggagcatttttttcttggagggattttcccagtacccagggttagaagtggttctcttcgtcttcagccttgtaatgtatctgacaacgctcttgggcaacagcactcttattttgatcactatcctagattcacgccttaaaacccccatgtacttattccttggaaatctctctttcatggatatttgttacacatctgcctctgttcctactttgctggtgaacttgctgtcatcccagaaaaccattatcttttctgggtgtgctgtacagatgtatctgtcccttgccatgggctccacagagtgtgtgctcctggccgtgatggcatatgaccgttatgtggccatttgtaacccgctgagatactccatcatcatgaacaggtgcgtctgtgcacggatggctacggtctcctgggtgacgggttgcctgaccgctctgctggaaaccagttttgccctgcagatacccctctgtgggaatctcatcgatcacttcacgtgtgaaattctggcggtgctaaagttagcttgcacaagttcactgctcatgaacaccatcatgctggtggtcagcattctcctcttgccaattccaatgctcttagtttgcatctcttacatcttcatcctttccactattctgagaatcacctcagcagagggaagaaacaaggctttttctacctgtggtgcccatttgactgtggtgattttgtattatggggctgccctctctatgtacctaaagccttcttcatcaaatgcacaaaaaatagacaaaatcatctcgttgctttacggagtgcttacccctatgttgaaccccataatttacagtttaagaaacaaggaagtcaaagatgctatgaagaaattgctgggcaaaataacattgcatcaaacacacgaacatctctga

SEQ ID NO: 162172 - DNA, 1692 bp, Homo sapiens
  Payload ID: 11741
  Gene Symbol: OR2L13
  Gene Name: olfactory receptor, family 2, subfamily L, member 13
  Uniprot ID: Q8N349
  ENST ID: ENST00000358120
  CDS Start-End: 146-1084
agcaaaagttgaaaaatcagtaacccaagatgactaaccaaatcaatatgctgggcaggatgagacatcagtgtctgcctcagacagaagagcacacacaaaacatgacctctcactccaagcccagttacagcagaaagttttcatggagaaatggaatcacacttcaaatgatttcattttgttgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatggcctacgaccgttatttggccatctgccactctctctattatcctatccgcatgagtaaaatgatgtgtgtgaagatgattggaggctcttggacactggggtccatcaactccttggcacacacagtctttgcccttcatattccctactgcaggtctagggctattgaccatttcttctgcgatgtcccagccatgttgcttcttgcctgtacagatacttgggtctatgaatatatggtttttgtaagtacaagcctctttctccttttccctttcattggcatcacttcttcctgtggccgagtcctatttgctgtctatcatatgcactcaaaggaggggagaaaaaaggccttcaccaccatttcaacacatttaactgtagtgatcttttactatgcaccttttgtctacacctatcttcggcccaggaatctccgctcaccagctgaagacaagatcctggcagtcttctacaccatccttacccccatgctcaatcccattatctacagcctgaggaataaggaagtcctgggggctatgaggagagtgtttgggatattctctttcctgaaagaataatcatggccatccccactccctttgtatttcctctttccaagttgattccaacacgctagagcagggttgtccaatagaaatacaacataatttaaaattttctaataggtacatttaagcagtcaaataaatttaaataatatatttaattcaaaacaatgttataattaatattaatattaacaatattgatgttaattacatagcatactatttcaataaattatatgcaatatattatagtacatgtttgtacatatattactattaacgtgataatgtttattcttgtatattgacatagaatttcttcatgtaataacacaaatttgttaatgttgccttttactctgtttgcattctaagtcttcaaagtcttgtgtttgttttatagagtgcagcgcagcttggacaaaacacatttcaagtgcccagtagtcagtgtctatagtgttggacagcacattcttagagcatccccaatcaatagtttcagaagttatatatgcatgtgtatgtgcatgtatggtgtatacaaacatatttttgttatatacaatattgctgatgaactgaaaattaacaagtaaaatgcacatgctaaggta

SEQ ID NO: 162173 - DNA, 1883 bp, Homo sapiens
  Payload ID: 11741
  Gene Symbol: OR2L13
  Gene Name: olfactory receptor, family 2, subfamily L, member 13
  Uniprot ID: Q8N349
  ENST ID: ENST00000366478
  CDS Start-End: 338-1276
ccggaggacgcgctgctgcgagaccagccgcggcgtctttggcagtagtgggcgtgcttgcgggtccaggagggcccctctcccgcgaccgccgaccacgatgagagcgtgaagaccctctcgaaaggaagggctctgctctacacactggtgtctcctgcggaagggcagctgggcacgccttccagaccgagcaaaagttgaaaaatcagtaacccaagatgactaaccaaatcaatatgctgggcaggatgagacatcagtgtctgcctcagacagaagagcacacacaaaacatgacctctcactccaagcccagttacagcagaaagttttcatggagaaatggaatcacacttcaaatgatttcattttgttgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatggcctacgaccgttatttggccatctgccactctctctattatcctatccgcatgagtaaaatgatgtgtgtgaagatgattggaggctcttggacactggggtccatcaactccttggcacacacagtctttgcccttcatattccctactgcaggtctagggctattgaccatttcttctgcgatgtcccagccatgttgcttcttgcctgtacagatacttgggtctatgaatatatggtttttgtaagtacaagcctctttctccttttccctttcattggcatcacttcttcctgtggccgagtcctatttgctgtctatcatatgcactcaaaggaggggagaaaaaaggccttcaccaccatttcaacacatttaactgtagtgatcttttactatgcaccttttgtctacacctatcttcggcccaggaatctccgctcaccagctgaagacaagatcctggcagtcttctacaccatccttacccccatgctcaatcccattatctacagcctgaggaataaggaagtcctgggggctatgaggagagtgtttgggatattctctttcctgaaagaataatcatggccatccccactccctttgtatttcctctttccaagttgattccaacacgctagagcagggttgtccaatagaaatacaacataatttaaaattttctaataggtacatttaagcagtcaaataaatttaaataatatatttaattcaaaacaatgttataattaatattaatattaacaatattgatgttaattacatagcatactatttcaataaattatatgcaatatattatagtacatgtttgtacatatattactattaacgtgataatgtttattcttgtatattgacatagaatttcttcatgtaataacacaaatttgttaatgttgccttttactctgtttgcattctaagtcttcaaagtcttgtgtttgttttatagagtgcagcgcagcttggacaaaacacatttcaagtgcccagtagtcagtgtctatagtgttggacagcacattcttagagcatccccaatcaatagtttcagaagttatatatgcatgtgtatgtgcatgtatggtgtatacaaacatatttttgttatatacaatattgctgatgaactgaaaattaacaagtaaaatgcacatgctaaggt

SEQ ID NO: 162174 - DNA, 939 bp, Homo sapiens
  Payload ID: 11742
  Gene Symbol: OR2L2
  Gene Name: olfactory receptor, family 2, subfamily L, member 2
  Uniprot ID: Q8NH16
  ENST ID: ENST00000366479
  CDS Start-End: 1-939
atggaaaattacaatcaaacatcaactgatttcatcttattggggctgttcccacaatcaagaattggccttttcgtattcaccctcatttttctcattttcctaatggctctaattggaaatctatccatgattcttctcatctttttggacatccatctccacacacctatgtatttcctacttagtcagctctccctcattgacctaaattacatctccaccattgttccaaagatggtttatgattttctgtatggaaacaagtctatctccttcactggatgtgggattcagagtttcttcttcttgactttagcagttgcagaagggctgctcctgacatcaatggcctatgatcgttatgtggccatttgctttcctctccactatcccatccgtataagcaaaagagtgtgtgtgatgatgataacaggatcttggatgataagctctatcaactcttgtgctcacacagtatatgcactctgtatcccatattgcaagtccagagccatcaatcattttttctgtgatgttccagctatgttgacgctagcctgcacagacacttgggtctatgagagcacagtgtttttgagcagcaccatctttcttgtgcttcctttcactggtattgcatgttcctatggccgggttctccttgctgtctaccgcatgcactctgcagaagggaggaagaaggcctattcaacctgtagcacccacctcactgtagtgtccttctactatgcaccctttgcttatacctatgtacgtccaagatccctgcgatctccaacagaggacaagattctggctgttttctacaccatcctcaccccaatgctcaaccccatcatctacagcctgagaaacaaggaggtgatgggggccctgacacaagtgattcagaaaatcttctcagtgaaaatgtag

SEQ ID NO: 162175 - DNA, 939 bp, Homo sapiens
  Payload ID: 11743
  Gene Symbol: OR2L3
  Gene Name: olfactory receptor, family 2, subfamily L, member 3
  Uniprot ID: Q8NG85
  ENST ID: ENST00000359959
  CDS Start-End: 1-939
atggaaaattacaatcaaacatcaactgatttcatcttattaggattcttcccaccatcaagaattggccttttcctcttcatcctcattgttttcattttcctaatggctctaattggaaacctatccatgattcttctcatcttcttggacacccatctccacacacccatgtatttcctacttagtcagctctccctcattgacctaaattacatctccaccattgttcctaagatggcatctgattttctgtctggtaacaagtctatctccttcactgggtgtgggattcagagtttcttcttctcggcattaggaggtgcagaagcactacttttggcatctatggcctatgatcgttacattgctatttgctttcctcttcactatcccatccgcatgagcaaaagaatgtgtgtgctgatgataacagggtcttggatcataggctcgatcaatgcttgtgctcacactgtatatgtactccatattccttattgccaatccagggccatcaatcatttcttctgtgatgtcccagcaatggtgactctggcctgcatggacacctgggtctatgagggcacagtgtttttgagcaccaccatctttctcgtgtttcccttcattgctatttcatgttcctatggccgggttctccttgctgtctaccacatgaaatctgcagaagggaggaagaaagcctacctgacctgcagcacccacctcactgtagtaactttctactatgcaccttttgtctacacttatctacgtccaagatccctgcgatctccaacagaggacaaggttctggctgtcttctacaccaccctcactccaatgctcaaccccatcatctatagcctgaggaacaaggaggtgatgggggccctgacacgagtgagtcagagaatctgctctgggaaaatgtag

SEQ ID NO: 162176 - DNA, 939 bp, Homo sapiens
  Payload ID: 11744
  Gene Symbol: OR2L5
  Gene Name: olfactory receptor, family 2, subfamily L, member 5
  Uniprot ID: Q8NG80
  ENST ID: ENST00000355281
  CDS Start-End: 1-939
atggaaaattacaatcaaacgtcaactgatttcatcttattggggctgttcccaccatcaaaaattggccttttcctcttcattctctttgttctcattttcctaatggctctaattggaaacctatccatgattcttctcatcttcttggacacccatctccacacacccatgtatttcctgcttagtcagctctccctcattgacctaaattacatctctacgattgttcctaagatggcttctgattttctgtatggaaacaagtctatctccttcattgggtgtgggattcagagtttcttcttcatgacttttgcaggtgcagaagcgctgctcctgacatcaatggcctatgatcgttatgtggccatttgctttcctctccactatcccatccgtatgagcaaaagaatgtatgtgctgatgataacaggatcttggatgataggctccatcaactcttgtgctcacacagtatatgcattccgtatcccatattgcaagtccagagccatcaatcattttttctgtgatgttccagctatgttgacattagcctgtacagacacctgggtctatgagtacacagtgtttttgagcagcaccatctttcttgtgtttcccttcactggcattgcgtgttcctatggctgggttctccttgctgtctaccgcatgcactctgcagaagggaggaaaaaggcctattcgacctgcagcacccacctcactgtagtaactttctactatgcaccctttgcttatacctatctatgtccaagatccctgcgatctctgacagaggacaaggttctggctgttttctacaccatcctcaccccaatgctcaaccccatcatctacagcctgagaaacaaggaggtgatgggggccctgacacgagtgattcagaatatcttctcggtgaaaatgtag

SEQ ID NO: 162177 - DNA, 939 bp, Homo sapiens
  Payload ID: 11745
  Gene Symbol: OR2L8
  Gene Name: olfactory receptor, family 2, subfamily L, member 8 (gene/pseudogene)
  Uniprot ID: Q8NGY9
  ENST ID: ENST00000357191
  CDS Start-End: 1-939
atggaaaattacaatcaaacatcaactgatttcatcttattggggctgtttccaccatcaagaattgaccttttcttcttcattctcattgttttcattttcctgatggctctaattggaaacctgtccatgattcttctcatcttcttggacacccatctccacacacccatgtatttcctactgagtcagctctccctcattgacctaaattacatctccaccattgttcctaagatggcatctgattttctgcatggaaacaagtctatctccttcactgggtgtgggattcagagtttcttcttcttggcattaggaggtgcagaagcactacttttggcatctatggcctatgatcgttacattgctatttgctttcctctccactatctcatccgcatgagcaaaagagtgtgtgtgctgatgataacagggtcttggatcataggctcgatcaatgcttgtgctcacactgtatatgtactccatattccttattgccgatccagggccatcaatcatttcttctgtgatgtcccagcaatggtgactctggcctgcatggacacctgggtctatgagggcacagtgtttttgagtgccaccatctttctcgtgtttcccttcattggtatttcatgttcctatggccaggttctctttgctgtctaccacatgaaatctgcagaagggaggaagaaagcctatttgacctgcagcacccacctcactgtagtaactttctactatgcaccttttgtctacacttatctacgtccaagatccctgcgatctccaacagaggacaaggttctggctgtcttctacaccatcctcaccccaatgctcaaccccatcatctatagcctgaggaacaaggaggtgatgggggccctgacacgagtgagtcagagaatctgctctgtgaaaatgtag

SEQ ID NO: 162178 - DNA, 1044 bp, Homo sapiens
  Payload ID: 11746
  Gene Symbol: OR2M2
  Gene Name: olfactory receptor, family 2, subfamily M, member 2
  Uniprot ID: Q96R28
  ENST ID: ENST00000359682
  CDS Start-End: 1-1044
atggcatgggagaatcagaccttcaactccgacttcatcctccttggaatcttcaatcacagcccaccacacacgttcctcttctttctggtcctgggcatctttttagtggccttcatgggaaactctgtcatggttctcctcatctacctggacacccagctccacacccccatgtacttcctcctcagccaactgtccctcatggacctcatgctcatctgcaccaccgtacccaagatggccttcaactacctgtctggcagcaagtccatttctatggctggttgtgtcacacaaattttcttctatatatcactgtctggctctgaatgttttcttttggctgttatggcttatgaccgctatattgctatttgccaccctctaagatataccaatctcatgaatcctaaaatttgtggacttatggctaccttctcctggatcctgggctctacagatggaatcattgatgctgtagccacattttccttctccttttgtgggtctcgggaaatagcccacttcttctgtgaattcccttccctactaatcctctcatgcaatgacacatcaatatttgaagaggttattttcatctgctgtatagtaatgcttgttttccctgttgcaatcatcattgcttcctatgctcgagttattctggctgtcattcacatgggatctggagagggtcgttgcaaagctttcacgacctgttcctctcacctcatggtggtgggaatgtactatggagcagctttgttcatgtacatacggcccacatctgatcactccccaacgcaggacaagatggtgtctgtattctacaccatcctcactcccatgctgaatcccctcatctacagcctccgcaacaaggaggtgactagagcattcatgaagatcttaggaaagggcaagtctgagagtgagttacctcataaactttatgttttgctgtttgctaaattcttctttctaatatccatctttttctatgatgtcaaaatactagcattgattatgtacattgcctaa

SEQ ID NO: 162179 - DNA, 939 bp, Homo sapiens
  Payload ID: 11747
  Gene Symbol: OR2M3
  Gene Name: olfactory receptor, family 2, subfamily M, member 3
  Uniprot ID: Q8NG83
  ENST ID: ENST00000456743
  CDS Start-End: 1-939
atggcaagggagaattcgaccttcaactccgacttcatcctcctgggaatcttcaatcacagccccacccacaccttcctcttctttctggtcctggccatcttttcagtggccttcatgggaaactctgtcatggttctcctcatctacctggacacccagctccacacccccatgtacctcctcctcagccaactgtccctcatggacctcatgctcatctgcaccaccgtacccaagatggccttcaactacctgtctggcagcaagtccatttctatggctggttgtgccacacaaattttcttctatacatcactgcttggctctgagtgctttcttttggctgttatggcttatgaccgctacactgccatttgccaccctctaagatacaccaatctcatgagccctaaaatttgtggacttatgactgccttttcctggatcctgggctctacggatggaattattgatgttgtagcaacattttccttctcctactgtgggtctcgggaaatagcccacttcttctgtgacttcccctccctactaatcctctcatgcagtgacacatcaatatttgaaaagattcttttcatctgctgtatagtaatgattgttttccctgttgcaatcatcattgcttcctatgctcgagttatcctggctgtcattcacatgggatctggagagggtcgtcgcaaagcttttactacttgttcctctcacctcttggtggtgggaatgtactatggagcagctttgttcatgtacatacggcccacatctgatcgctccccaacacaggacaagatggtgtctgtattctacaccatcctcactcccatgttgaatcccctcatctacagcctccgcaacaaggaggtgaccagagcattcatgaagatcttaggaaagggcaagtctggagagtga

SEQ ID NO: 162180 - DNA, 936 bp, Homo sapiens
  Payload ID: 11748
  Gene Symbol: OR2M4
  Gene Name: olfactory receptor, family 2, subfamily M, member 4
  Uniprot ID: Q96R27
  ENST ID: ENST00000306687
  CDS Start-End: 1-936
atggtgtgggaaaaccagaccttcaactccatcttcatcctgctgggaatcttcaatcacagtcccacccacaccttccttttttctctggtcctgggcatcttctcactggcattgatggaaaatatttccatggttctcctcatctacatagagaaacagctccacacccccatgtacttcctcctcagtcaactgtcccttatggacctcatgctcatctgcaccactctacccaagatgatcttcagctacttgtctgggaagaaatctatctctctggcaggttgtggaactcagatattcttctatgtgtccctgcttggagctgaatgtttcttgttggctgtcatggcttatgaccgctatgtggctatatgtcaccctcttcagtacaccatcctcatgaatccgaaactctgtgtcttcatgactgttgcttcctggaccttggggtctcttgatgggatcatagtgcttgcagctgtcctgtcattttcttactgcagctctctggaaattcatcactttttctgtgatgttgctgcccttttacctctatcctgcacagaaacatctgcatttgaaagactacttgtcatttgttgtgtggtaatgctaatctttccagtttcagttatcatactttcctattcccatgtccttcgagccgtcatccacatgggctctggggaaagtcgtcgcaaggccttcactacctgctcctcccacctgtctgtggtcggactctactacggtgctgctatgttcatgtacatgagaccagcttctaaacatacgccagaccaggacaagatggtgtcggccttctacactattctcacccctatgctgaaccctctcatttatagcctccgcaacaaagaagtgttcagggcactacagaaggtactgaagaaaagaaagttaatatga

SEQ ID NO: 162181 - DNA, 939 bp, Homo sapiens
  Payload ID: 11749
  Gene Symbol: OR2M5
  Gene Name: olfactory receptor, family 2, subfamily M, member 5
  Uniprot ID: A3KFT3
  ENST ID: ENST00000366476
  CDS Start-End: 1-939
atggcatgggagaatcagaccttcaactctgacttcatcctcctgggaatcttcaatcacagccccacccacaccttcctcttctttctggtcctggccatcttttcagtggccttcatgggaaactctgtcatggttctcctcatctacctggacacccagctccacacccccatgtacttcctcctcagtcaactgttcctcatggacctcatgctcatctgctctaccgtacccaagatggccttcaactacttgtctggcagcaagtccatttctatggctggttgtgccacacaaattttcttctatgtatcactgcttggctccgaatgctttctgttggctgttatgtcttatgaccgctatattgccatttgccaccctctaagatacaccaatctcatgagacccaaaatttgtggacttatgactgccttctcctggatcctgggctctatggatgcaatcattgatgctgtagcgacattttccttctcctactgtgggtctcgggaaatagcccacttcttctgtgacttcccttccctactaatcctctcatgcaatgacacatcaatatttgaaaaggttcttttcatctgctgtatagtaatgattgtttttcctgttgcaatcatcatcgcttcctatgctcgagttattctggctgtcattcacatgggatctggagagggtcgtcgcaaagcttttactacctgttcctctcacctcatggtggtgggaatgtactatggagcaggtttgttcatgtacatacggcccacatctgatcgctcccctatgcaggacaagctggtgtctgtattctacaccatcctcactcccatgctgaatcccctcatctacagcctccgcaacaaggaggtgaccagagcactcaggaaagtgttaggaaagggcaagtgtggagagtga

SEQ ID NO: 162182 - DNA, 939 bp, Homo sapiens
  Payload ID: 11750
  Gene Symbol: OR2M7
  Gene Name: olfactory receptor, family 2, subfamily M, member 7
  Uniprot ID: Q8NG81
  ENST ID: ENST00000317965
  CDS Start-End: 1-939
atggcatgggagaatcagaccttcaactctgacttcctcctcctgggaatcttcaatcatagccccacccacaccttcctcttctttctggtcctggccatcttttcagtggccttcatgggaaactccatcatggttctcctcatctacctggatacccagctccacacccccatgtacttcctcctcagccaactgtccctcatggacctcatgctcatctgcaccactgtacccaagatggccttcaactacttgtctggcagcaagtccatttctatggctggctgtgccacacaaattttcttctatatatcattgcttggctccgaatgctttctgttggctgttatgtcttatgaccgctacactgccatttgccaccctctaagatacaccaatctcatgagacccaaaatttgtggacttatgactgccttctcctggatcctgggctctacagatggaatcattgatgctgtagcgacattttccttctcctactgtgggtctcgggaaatagcccacttctgctgtgacttcccttccctactaatcctctcatgcaatgacacatcaatatttgaagaggttattttcatctgctgtatagtaatgcttgttttccctgttgcaatcatcatcacttcctatgctcgagttattctggctgtcattcacatgggatctggagagggacgtcgcaaagcttttactacttgttcctctcacctcatggtggtgggaatgtactatggagcaggtttgttcatgtgcattcagcccacatctcatcattctcctatgcaggacaagatggtgtctgtattctacaccatcgtcactcccatgctgaatcctctcatttatagcctccgcaacaaggaagtgaccagagcattaatgaaaatcttaggaaagggcaagtctggagattga

SEQ ID NO: 162183 - DNA, 1047 bp, Homo sapiens
  Payload ID: 11751
  Gene Symbol: OR2S2
  Gene Name: olfactory receptor, family 2, subfamily S, member 2 (gene/pseudogene)
  Uniprot ID: Q9NQN1
  ENST ID: ENST00000341959
  CDS Start-End: 57-1016
tcccaaaaagcctgatgcgctgctcagtactttgctgatggcagaggggatatcacatggaaaaagccaatgagacctcccctgtgatggggttcgttctcctgaggctctctgcccacccagagctggaaaagacattcttcgtgctcatcctgctgatgtacctcgtgatcctgctgggcaatggggtcctcatcctggtgaccatccttgactcccgcctgcacacgcccatgtacttcttcctagggaacctctccttcctggacatctgcttcactacctcctcagtcccactggtcctggacagctttttgactccccaggaaaccatctccttctcagcctgtgctgtgcagatggcactctcctttgccatggcaggaacagagtgcttgctcctgagcatgatggcatttgatcgctatgtggccatctgcaacccccttaggtactccgtgatcatgagcaaggctgcctacatgcccatggctgccagctcctgggctattggtggtgctgcttccgtggtacacacatccttggcaattcagctgcccttctgtggagacaatgtcatcaaccacttcacctgtgagattctggctgttctaaagttggcctgtgctgacatttccatcaatgtgatcagcatggaggtgacgaatgtgatcttcctaggagtcccggttctgttcatctctttctcctatgtcttcatcatcaccaccatcctgaggatcccctcagctgaggggaggaaaaaggtcttctccacctgctctgcccacctcaccgtggtgatcgtcttctacgggaccttattcttcatgtatgggaagcctaagtctaaggactccatgggagcagacaaagaggatctttcagacaaactcatcccccttttctatggggtggtgaccccgatgctcaaccccatcatctatagcctgaggaacaaggatgtgaaggctgctgtgaggagactgctgagaccaaaaggcttcactcagtgatggtggaagggtcctctgtgattgtcaccca

SEQ ID NO: 162184 - DNA, 960 bp, Homo sapiens
  Payload ID: 11751
  Gene Symbol: OR2S2
  Gene Name: olfactory receptor, family 2, subfamily S, member 2 (gene/pseudogene)
  Uniprot ID: Q9NQN1
  ENST ID: ENST00000625188
  CDS Start-End: 1-960
atggaaaaagccaatgagacctcccctgtgatggggttcgttctcctgaggctctctgcccacccagagctggaaaagacattcttcgtgctcatcctgctgatgtacctcgtgatcctgctgggcaatggggtcctcatcctggtgaccatccttgactcccgcctgcacacgcccatgtacttcttcctagggaacctctccttcctggacatctgcttcactacctcctcagtcccactggtcctggacagctttttgactccccaggaaaccatctccttctcagcctgtgctgtgcagatggcactctcctttgccatggcaggaacagagtgcttgctcctgagcatgatggcatttgatcgctatgtggccatctgcaacccccttaggtactccgtgatcatgagcaaggctgcctacatgcccatggctgccagctcctgggctattggtggtgctgcttccgtggtacacacatccttggcaattcagctgcccttctgtggagacaatgtcatcaaccacttcacctgtgagattctggctgttctaaagttggcctgtgctgacatttccatcaatgtgatcagcatggaggtgacgaatgtgatcttcctaggagtcccggttctgttcatctctttctcctatgtcttcatcatcaccaccatcctgaggatcccctcagctgaggggaggaaaaaggtcttctccacctgctctgcccacctcaccgtggtgatcgtcttctacgggaccttattcttcatgtatgggaagcctaagtctaaggactccatgggagcagacaaagaggatctttcagacaaactcatcccccttttctatggggtggtgaccccgatgctcaaccccatcatctatagcctgaggaacaaggatgtgaaggctgctgtgaggagactgctgagaccaaaaggcttcactcagtga

SEQ ID NO: 162185 - DNA, 1047 bp, Homo sapiens; identical to SEQ ID NO: 162183
  Payload ID: 11751
  Gene Symbol: OR2S2
  Gene Name: olfactory receptor, family 2, subfamily S, member 2 (gene/pseudogene)
  Uniprot ID: Q9NQN1
  ENST ID: ENST00000623973
  CDS Start-End: 57-1016

SEQ ID NO: 162186 - DNA, 1110 bp, Homo sapiens
  Payload ID: 11752
  Gene Symbol: OR2T1
  Gene Name: olfactory receptor, family 2, subfamily T, member 1
  Uniprot ID: O43869
  ENST ID: ENST00000366474
  CDS Start-End: 1-1110
atgtggcaagaatactattttttaaatgttttcttcccacttttaaaagtttgctgcctaacaattaattcacatgttgttattttactgccctgggaatgctatcatcttatttggaagatattaccttatatcggcacaactgtaggatcaatggaagagtacaacacatcctctacagacttcactttcatggggctgttcaacagaaaggaaacctcaggtcttatttttgccatcatctctatcatcttcttcaccgcactgatggccaatggggttatgatcttcctgatccaaacagatttgcgccttcatacacccatgtacttcctcctcagccacctttccttaattgacatgatgtatatttccactattgtgcctaagatgctggttaattacctgctggatcaaaggaccatttcctttgtggggtgcacagctcaacacttcctctaccttacccttgtgggagctgaattcttcctgctgggcctcatggcctatgaccgctatgtggccatttgcaaccctctgagataccctgtcctcatgagccgccgggtctgttggatgattatagcaggttcctggtttgggggctctttggatggcttcctcctaacccccatcaccatgagctttcccttctgcaattcccgggagattaaccacttcttctgtgaggcaccagcagtcctgaagttggcatgtgcagacacagccctctacgagacagtgatgtatgtgtgctgtgttttgatgctgctgattcctttctctgtagtccttgcttcctatgcccgaatcctgactacagttcagtgcatgagctcagtggagggcaggaagaaggcatttgccacttgctcatcccacatgactgtggtgtccttgttctacggggctgccatgtacacctacatgctgccacattcttaccacaagccagcccaggacaaagtcctctctgtgttttacaccattctcacacccatgctgaaccccctcatctacagccttagaaacaaggatgtgactggagctctgaagagggccttggggaggttcaagggtcctcaaagggtgtcaggaggtgtcttttga

SEQ ID NO: 162187 - DNA, 1110 bp, Homo sapiens; identical to SEQ ID NO: 162186
  Payload ID: 11752
  Gene Symbol: OR2T1
  Gene Name: olfactory receptor, family 2, subfamily T, member 1
  Uniprot ID: O43869
  ENST ID: ENST00000611851
  CDS Start-End: 1-1110

SEQ ID NO: 162188 - DNA, 1110 bp, Homo sapiens; identical to SEQ ID NO: 162186
  Payload ID: 11752
  Gene Symbol: OR2T1
  Gene Name: olfactory receptor, family 2, subfamily T, member 1
  Uniprot ID: O43869
  ENST ID: ENST00000613540
  CDS Start-End: 1-1110

SEQ ID NO: 162189 - DNA, 939 bp, Homo sapiens
  Payload ID: 11753
  Gene Symbol: OR2T10
  Gene Name: olfactory receptor, family 2, subfamily T, member 10
  Uniprot ID: Q8NGZ9
  ENST ID: ENST00000330500
  CDS Start-End: 1-939
atgcggctggccaaccagaccctgggtggtgactttttcctgttgggaatcttcagccagatctcacaccctggccgcctctgcttgcttatcttcagtatatttttgatggctgtgtcttggaatattacattgatacttctgatccacattgactcctctctgcatactcccatgtacttctttataaaccagctctcactcatagacttgacatatatttctgtcactgtccccaaaatgctggtgaaccagctggccaaagacaagaccatctcggtccttgggtgtggcacccagatgtacttctacctgcagttgggaggtgcagagtgctgccttctagccgccatggcctatgaccgctatgtggctatctgccatcctctccgttactctgtgctcatgagccatagggtatgtctcctcctggcatcaggctgctggtttgtgggctcagtggatggcttcatgctcactcccatcgccatgagcttccccttctgcagatcccatgagattcagcacttcttctgtgaggtccctgctgttttgaagctctcttgctcagacacctcactttacaagattttcatgtacttgtgctgtgtcatcatgctcctgatacctgtgacggtcatttcagtgtcttactactatatcatcctcaccatccataagatgaactcagttgagggtcggaaaaaggccttcaccacctgctcctcccacattacagtggtcagcctcttctatggagctgctatttacaactacatgctccccagctcctaccaaactcctgagaaagatatgatgtcatcctttttctacactatccttacacctgtcttgaatcctatcatttacagtttcaggaataaggatgtcacaagggctttgaaaaaaatgctgagcgtgcagaaacctccatattaa

SEQ ID NO: 162190 - DNA, 951 bp, Homo sapiens; identical to SEQ ID NO: 161881
  Payload ID: 11754
  Gene Symbol: OR2T11
  Gene Name: olfactory receptor, family 2, subfamily T, member 11 (gene/pseudogene)
  Uniprot ID: Q8NH01
  ENST ID: ENST00000330803
  CDS Start-End: 1-951

SEQ ID NO: 162191 - DNA, 963 bp, Homo sapiens
  Payload ID: 11755
  Gene Symbol: OR2T12
  Gene Name: olfactory receptor, family 2, subfamily T, member 12
  Uniprot ID: Q8NG77
  ENST ID: ENST00000317996
  CDS Start-End: 1-963
atggagatgagaaatactaccccagattttattctcctaggactctttaaccacaccagagcccaccaagtcctcttcatgatgcttctggccaccgttttgacctccctgtttagcaatgccctcatgattctcctgattcactgggaccaccggctccacaggcccatgtacttcctcctgagccaactttccctcatggacatgatgctggtttccaccactgtgcccaaaatggcggctgactacttgaccggaaataaggccatctcccgcgctggctgtggtgtgcagatcttcttcctccccacactgggtggtggagagtgcttcctcttagcagccatggcctatgaccgctatgcggctgtctgccacccactccgatatcccactctcatgagctggcagctgtgcctgaggatgaccatgtcgtcctggctcctgggtgcagctgacggcctcctgcaggctgttgctaccctgagcttcccatattgcggtgcacacgagatcgatcacttcttctgcgaggcccccgtgttggtgcgtttggcttgtgctgacacttcagtcttcgaaaacgccatgtacatctgctgtgtgttaatgctcctggtccccttttccctcatcctgtcctcctatggtctcatcctcgctgctgttctgctcatgcgctctacagaagcccgcaagaaggcctttgccacctgctcttcacatgtggctgtggtgggactcttttatggagctggcatttttacctatatgagacccaaatcccacaggtccactaaccacgataaggttgtgtcagccttctatactatgttcacccctttactaaatcccctcatctacagtgtgaggaacagtgaggtcaaggaagccctgaaacggtggctggggacgtgtgtaaacctaaaacaccagcaaaatgaggcccacaggtcaagatga

SEQ ID NO: 162192 - DNA, 975 bp, Homo sapiens
  Payload ID: 11756
  Gene Symbol: OR2T2
  Gene Name: olfactory receptor, family 2, subfamily T, member 2
  Uniprot ID: Q6IF00
  ENST ID: ENST00000342927
  CDS Start-End: 1-975
atgggcatggagggtcttctccagaactccactaacttcgtcctcacaggcctcatcacccatcctgccttccccgggcttctctttgcaatagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcagatcttcctctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtctcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctag

SEQ ID NO: 162193 - DNA, 975 bp, Homo sapiens; identical to SEQ ID NO: 162192
  Payload ID: 11756
  Gene Symbol: OR2T2
  Gene Name: olfactory receptor, family 2, subfamily T, member 2
  Uniprot ID: Q6IF00
  ENST ID: ENST00000616594
  CDS Start-End: 1-975

SEQ ID NO: 162194 - DNA, 1054 bp, Homo sapiens
  Payload ID: 11756
  Gene Symbol: OR2T2
  Gene Name: olfactory receptor, family 2, subfamily T, member 2
  Uniprot ID: Q6IF00
  ENST ID: ENST00000610282
  CDS Start-End: 23-997
cccaaggagcttgtcatggaccatgggcatggagggtcttctccagaactccactaacttcgtcctcacaggcctcatcacccatcctgccttccccgggcttctctttgcaatagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcagatcttcctctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtctcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctagcagggactcccacagcatcagagtggtgactgtgatcgggaaggattagcggggact

SEQ ID NO: 162195 - DNA, 954 bp, Homo sapiens
  Payload ID: 11757
  Gene Symbol: OR2T27
  Gene Name: olfactory receptor, family 2, subfamily T, member 27
  Uniprot ID: Q8NH04
  ENST ID: ENST00000344889
  CDS Start-End: 1-954
atggagcagagcaattattccgtgtatgccgactttatccttctgggtttgttcagcaacgcccgtttcccctggcttctctttgccctcattctcctggtctttttgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctatgatcgctacgtagccatctgcaaccctctgcactatcctgtcctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtcatctcgggctcttacacaagaattctcattactgtttataggatgagcgaggcagaggggaggggaaaggctgtggccacctgctcctcacacatggtggttgtcagcctcttctatggggctgccatgtacacatacgtgctgcctcattcttaccacacccctgagcaggacaaagctgtatctgccttctacaccatccttactcccatgctcaatccactcatttacagccttaggaacaaggatgtcacaggggccctacagaaggttgtggggaggtgtgtgtcctcaggaaaggtaaccactttctaa

SEQ ID NO: 162196 - DNA, 948 bp, Homo sapiens
  Payload ID: 11758
  Gene Symbol: OR2T29
  Gene Name: olfactory receptor, family 2, subfamily T, member 29
  Uniprot ID: Q8NH02
  ENST ID: ENST00000328570
  CDS Start-End: 1-948
atggccaacatcaccaggatggccaaccacactggaaggttggatttcatcctcatgggactcttcagacaatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttag

SEQ ID NO: 162197 - DNA, 957 bp, Homo sapiens
  Payload ID: 11759
  Gene Symbol: OR2T3
  Gene Name: olfactory receptor, family 2, subfamily T, member 3
  Uniprot ID: Q8NH03
  ENST ID: ENST00000359594
  CDS Start-End: 1-957
atgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttctacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagacgctcatgtacctgtgctgcatcctcatgcttctcgcccccatcatggtcatctccagctcatacaccctcatcctgcatctcatccacaggatgaattctgccgccggccacaggaaggccttggccacctgctcctcccacatgatcatagtgctgctgctcttcggtgcttccttctacacctacatgctcccgagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtag

SEQ ID NO: 162198 - DNA, 957 bp, Homo sapiens; identical to SEQ ID NO: 162197
  Payload ID: 11759
  Gene Symbol: OR2T3
  Gene Name: olfactory receptor, family 2, subfamily T, member 3
  Uniprot ID: Q8NH03
  ENST ID: ENST00000610467
  CDS Start-End: 1-957

SEQ ID NO: 162199 - DNA, 1008 bp, Homo sapiens
  Payload ID: 11759
  Gene Symbol: OR2T3
  Gene Name: olfactory receptor, family 2, subfamily T, member 3
  Uniprot ID: Q8NH03
  ENST ID: ENST00000614898
  CDS Start-End: 26-982
tcctcagggggaaactgagccagtcatgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttctacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagacgctcatgtacctgtgctgcatcctcatgcttctcgcccccatcatggtcatctccagctcatacaccctcatcctgcatctcatccacaggatgaattctgccgccggccacaggaaggccttggccacctgctcctcccacatgatcatagtgctgctgctcttcggtgcttccttctacacctacatgctcccgagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtagtaaagggcaagcattgtcccctcctc

SEQ ID NO: 162200 - DNA, 963 bp, Homo sapiens
  Payload ID: 11760
  Gene Symbol: OR2T33
  Gene Name: olfactory receptor, family 2, subfamily T, member 33
  Uniprot ID: Q8NG76
  ENST ID: ENST00000318021
  CDS Start-End: 1-963
atggagatgagaaatactaccccagattttattctcctaggactctttaaccacaccagagcccaccaagtcctcttcatgatggttctgagtatcgttttgacctccctgtttggcaattccctcatgattctcctgattcactgggaccaccggctccacacgcccatgtacttcctcctgagccaactttccctcatggacatgatgctggtttccaccactgtgcccaaaatggcggctgactacttgaccggaagtaaggccatctcccgcgctggctgtggtgtgcagatcttcttcctccccacactgggtggtggagagtgcttcctcttagcagccatggcctatgaccgctatgcggctgtctgccacccactccgatatcccactctcatgagctggcagctgtgcctgaggatgaccatgtcgtgttggctcctgggtgcagctgacgggctcctgcaggctgttgttaccctgagcttcccatattgtggtgcacacgagatcgatcacttcttctgcgagacccccgtgctggtgcgtttggcttgtgctgacacttcagtcttcgaaaacgccatgtacatctgctgtgtgttaatgctcctggtccccttttccctcatcctgtcctcctatggtctcatcctcgctgctgttctgcacatgcgctctacagaagcccgcaagaaggcctttgccacctgctcttcacatgtggctgtggtgggactcttttatggagctgccatttttacctatatgagacccaaatcccataggtccactaaccatgacaaggttgtgtcagccttctatactatgttcacccctttactaaaccccctcatctacagtgtgaagaacagtgaggtgaagggagccctgaaacggtggctggggacgtgtgtaaacataaaacaccagcaaaatgaggcccacaggtcaagatga

SEQ ID NO: 162201 - DNA, 957 bp, Homo sapiens
  Payload ID: 11761
  Gene Symbol: OR2T34
  Gene Name: olfactory receptor, family 2, subfamily T, member 34
  Uniprot ID: Q8NGX1
  ENST ID: ENST00000328782
  CDS Start-End: 1-957
atgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttccacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagatgctcacgtacctgtgctgcatcctcatgcttctcacccccatcatggtcatctccagctcatacaccctcatcctgcatctcatccacaggatgaattctgccgccggccgcaggaaggccttggccacctgctcctcccacatgatcatagtgctgctgctcttcggtgcttccttctacacctacatgctccggagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtag

SEQ ID NO: 162202 - DNA, 972 bp, Homo sapiens
  Payload ID: 11762
  Gene Symbol: OR2T35
  Gene Name: olfactory receptor, family 2, subfamily T, member 35
  Uniprot ID: Q8NGX2
  ENST ID: ENST00000317450
  CDS Start-End: 1-972
atgggcatggagggtcttctccagaactccactaacttcgtcctcacaggcctcatcacccatcctgccttccccgggcttctctttgcagtagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcaaatcttctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtgtcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctag

SEQ ID NO: 162203 - DNA, 1047 bp, Homo sapiens
  Payload ID: 11763
  Gene Symbol: OR2T4
  Gene Name: olfactory receptor, family 2, subfamily T, member 4
  Uniprot ID: Q8NH00
  ENST ID: ENST00000366475
  CDS Start-End: 1-1047
atggacaacatcacctggatggccagccacactggatggtcggatttcatcctgatgggactcttcagacaatccaaacatccaatggccaatatcacctggatggccaaccacactggatggtcggatttcatcctgttgggactcttcagacaatccaaacatccagcactactttgtgtggtcatttttgtggttttcctgatggcgttgtctggaaatgctgtcctgatccttctgatacactgtgacgcccacctccacacccccatgtactttttcatcagtcaattgtctctcatggacatggcgtacatttctgtcactgtgcccaagatgctcctggaccaggtcatgggtgtgaataagatctcagcccctgagtgtgggatgcagatgttcttctacgtgacactagcaggttcagaatttttccttctagccaccatggcctatgaccgctacgtggccatctgccatcctctccgttaccctgtcctcatgaaccatagggtgtgtctcttcctgtcatcaggctgctggttcctgggctcagtggatggcttcacattcactcccatcaccatgaccttccccttccgtggatcccgggagattcatcatttcttctgtgaagttcctgctgtattgaatctctcctgctcagacacctcactctatgagattttcatgtacttgtgctgtgtcctcatgctcctcatccctgtggtgatcatttcaagctcctatttactcatcctcctcaccatccacgggatgaactcagcagagggccggaaaaaggcctttgccacctgctcctcccacctgactgtggtcatcctcttctatggggctgccatctacacctacatgctccccagctcctaccacacccctgagaaggacatgatggtatctgtcttctataccatcctcactccagtggtgaaccctttaatctatagtcttaggaataaggatgtcatgggggctctgaagaaaatgttaacagtggaacctgcctttcaaaaagctatggagtag

SEQ ID NO: 162204 - DNA, 1047 bp, Homo sapiens; identical to SEQ ID NO: 162203
  Payload ID: 11763
  Gene Symbol: OR2T4
  Gene Name: olfactory receptor, family 2, subfamily T, member 4
  Uniprot ID: Q8NH00
  ENST ID: ENST00000621754
  CDS Start-End: 1-1047

SEQ ID NO: 162205 - DNA, 1047 bp, Homo sapiens; identical to SEQ ID NO: 162203
  Payload ID: 11763
  Gene Symbol: OR2T4
  Gene Name: olfactory receptor, family 2, subfamily T, member 4
  Uniprot ID: Q8NH00
  ENST ID: ENST00000622637
  CDS Start-End: 1-1047

SEQ ID NO: 162206 - DNA, 948 bp, Homo sapiens
  Payload ID: 11764
  Gene Symbol: OR2T5
  Gene Name: olfactory receptor, family 2, subfamily T, member 5
  Uniprot ID: Q6IEZ7
  ENST ID: ENST00000366473
  CDS Start-End: 1-948
atggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttag

SEQ ID NO: 162207 - DNA, 1034 bp, Homo sapiens
  Payload ID: 11764
  Gene Symbol: OR2T5
  Gene Name: olfactory receptor, family 2, subfamily T, member 5
  Uniprot ID: Q6IEZ7
  ENST ID: ENST00000611272
  CDS Start-End: 26-973
tccttggtggcctaggtgaaacctcatggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcaga

SEQ ID NO: 162208 - DNA, 948 bp, Homo sapiens; identical to SEQ ID NO: 162206
  Payload ID: 11764
  Gene Symbol: OR2T5
  Gene Name: olfactory receptor, family 2, subfamily T, member 5
  Uniprot ID: Q6IEZ7
  ENST ID: ENST00000620813
  CDS Start-End: 1-948

SEQ ID NO: 162209 - DNA, 927 bp, Homo sapiens
  Payload ID: 11765
  Gene Symbol: OR2T6
  Gene Name: olfactory receptor, family 2, subfamily T, member 6
  Uniprot ID: Q8NHC8
  ENST ID: ENST00000355728
  CDS Start-End: 1-927
atgaatgaaaacaatgaaaccttgaccagaggctttaccctcatggggctcttcactcacaataaatgctcaggattctttttcggtgtcatttgtgccgtcttcttcatggccatgatagctaatggggtcatgatcttcctgattaacatagaccctcatctccacacccccatgtacttcctcctcagccacctctccgtcattgacacattatacatctccaccattgtgcccaagatgctggtagattatctcatgggcgaggggaccatctctttcatcgcctgcactgctcagtgctttctctacatgggctttatgggggctgaattcttcctgctggggctcatggcctatgaccgctacgtggccatctgcaacccactgcgctatcctgtcctcatcagctggcgggtctgctggatgatcctggccagctcttggttcggtggggctttggacagttttctcctcacccccattaccatgagtctcccgttctgtgcctctcaccaaatcaatcactttttctgtgaggcacccaccatgctgaggctggcctgtggggacaaaaccacctatgaaacagtgatgtatgtgtgctgcgttgcaatgctgctgatccccttctcggtggtgactgcatcctacaccaggattctcatcacagtgcatcagatgacatcggctgaagggaggaagaaggcctttgccacctgctcttcacacatgatggtggtgacattgttctatggggctgccttgtatacgtatacgcttccccaatcttaccacaccccaatcaaagataaggtcttctctgccttttataccatcctcacacccttattaaaccctctcatctacagtctgaggaacagggatgtgatgggtgccttgaagagagttgtggcaagatgttag

SEQ ID NO: 162210 - DNA, 927 bp, Homo sapiens; identical to SEQ ID NO: 162209
  Payload ID: 11765
  Gene Symbol: OR2T6
  Gene Name: olfactory receptor, family 2, subfamily T, member 6
  Uniprot ID: Q8NHC8
  ENST ID: ENST00000612137
  CDS Start-End: 1-927

SEQ ID NO: 162211 - DNA, 927 bp, Homo sapiens; identical to SEQ ID NO: 162209
  Payload ID: 11765
  Gene Symbol: OR2T6
  Gene Name: olfactory receptor, family 2, subfamily T, member 6
  Uniprot ID: Q8NHC8
  ENST ID: ENST00000621336
  CDS Start-End: 1-927

SEQ ID NO: 162212 - DNA, 927 bp, Homo sapiens
  Payload ID: 11766
  Gene Symbol: OR2T7
  Gene Name: olfactory receptor, family 2, subfamily T, member 7
  Uniprot ID: P0C7T2
  ENST ID: ENST00000626837
  CDS Start-End: 1-927
atgccgactttatccttctgggtttgttcagcaacgcccgtttcccctggcttctttgccctcattctcctggtctttgtgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctgtgatcgctacgtagccatctgcaaccctctgcactatcctgacctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtgatctcgggctcttacacaagaattctcattactgtttataggatgagcgaggcagaggggaggcgaaaggctgtggccacctgctcctcacacatggtggttgtcagcctcttctatggggctgccatgtacacatacgtgctgcctcattcttaccacacccctgagcaggacaaagctgtatctgccttctacaccatcctcactcccatgctcaatccactcatttacagccttaggaacaaggatgtcacgggggccctacagaaggttgttgggaggtgtgtgtcctcaggaaaggtaaccactttctaa

SEQ ID NO: 162213 - DNA, 927 bp, Homo sapiens; identical to SEQ ID NO: 162212
  Payload ID: 11766
  Gene Symbol: OR2T7
  Gene Name: olfactory receptor, family 2, subfamily T, member 7
  Uniprot ID: P0C7T2
  ENST ID: ENST00000626892
  CDS Start-End: 1-927

SEQ ID NO: 162214 - DNA, 939 bp, Homo sapiens
  Payload ID: 11767
  Gene Symbol: OR2T8
  Gene Name: olfactory receptor, family 2, subfamily T, member 8
  Uniprot ID: A6NH00
  ENST ID: ENST00000319968
  CDS Start-End: 1-939
atggaaaatgggagctatacctcttatttcattctcctaggactctttaaccacaccagagcccaccaagtcctcttcatgatggttctgagtatcgttttgacctccctgtttggcaattccctcatgattctcctgattcactgggaccaccggctccacacgcccatgtacttcctcctgagccaactttccctcatggacgtgatgctggtttccaccactgtgcccaaaatggcggctgactacttgaccggaagtaaggccatctcccgcgctggctgtggtgcgcagatcttcttcctccccacactgggtggtggagagtgcttcctcttagcagccatggcctatgaccgctatgcggctgtctgccacccactccgatatcccactctcatgagctggcagctgtgcctgaggatgaacctgtcgtgttggctcctgggtgcagctgacgggctcctgcaggctgttgctaccctgagcttcccatattgcggtgcacacgagatcgatcacttcttctgcgagacccccgtgctggtgcgtttggcttgtgctgacacttcagtcttcgaaaacgccatgtacatctgctgtgtgttaatgctcctggtccccttttccctcatcctgtcctcctatggtctcatcctcgctgctgttctgcacatgcgctctacagaagcccgcaagaaggcctttgccacctgctcttcacatgtggctgtggtgggactcttttatggagctgccatttttacctatatgagacccaaatcccacaggtccactaaccacgacaaggttgtgtcagccttctatactatgttcacccctttactaaaccccctcatctacagtgtgaagaacagtgaggtgaagggagccctgacaaggtgtatgggtcggtgtgtggccttaagtcgtgaataa

SEQ ID NO: 162215 - DNA, 948 bp, Homo sapiens
  Payload ID: 11768
  Gene Symbol: OR2V1
  Gene Name: olfactory receptor, family 2, subfamily V, member 1
  Uniprot ID: Q8NHB1
  ENST ID: ENST00000329365
  CDS Start-End: 1-948
atgggaagatgggtgaaccagtcctacacagatggcttcttcctcttgggcatcttttcccacagccagactgaccttgtcctcttctctgcagttatggtggtcttcacagtggccctctgtgggaatgtcctcctcatcttcctcatctacctggacgctggacttcacacccccatgtacttcttcctcagccagctctccctcatggacctcatgttggtctgtaacattgtgccaaagatggcagccaacttcctgtctggcaggaagtccatctcctttgtgggctgtggcatacaaattggcttttttgtctctcttgtgggatctgaggggctcttgctgggactcatggcttatgaccgctacgtggccgttagccacccacttcactatcccatcctcatgaatcagagggtctgtctccagattactgggagctcctgggcctttgggataatagatggagtgattcagatggtggcagccatgggcttaccttactgtggctcaaggagcgtggatcactttttctgtgaggtacaagctttattgaagctggcctgtgcagacacttccctttttgacaccctcctctttgcttgctgtgtcttcatgcttctccttcccttctccatcatcatggcctcctatgcttgcatcctaggggctgtgctccgaatacgctctgctcaggcctggaaaaaagccctggccacctgctcctcccacctaacagctgtcaccctcttctatggggcagccatgttcatgtacctgaggcctaggcgctaccgggcccctagccatgacaaggtggcctctatcttctacacagtccttactcccatgctgaaccccctcatttacagcttgaggaatggggaggtgatgggggcactgaggaaggggctggaccgctgcaggattggcagccagcactga

SEQ ID NO: 162216 - DNA, 948 bp, Homo sapiens
  Payload ID: 11769
  Gene Symbol: OR2V2
  Gene Name: olfactory receptor, family 2, subfamily V, member 2
  Uniprot ID: Q96R30
  ENST ID: ENST00000328275
  CDS Start-End: 1-948
atggagacgtgggtgaaccagtcctacacagatggcttcttcctcttaggcatcttctcccacagtactgctgaccttgtcctcttctccgtggttatggcggtcttcacagtggccctctgtgggaatgtcctcctcatcttcctcatctacatggaccctcaccttcacacccccatgtacttcttcctcagccagctctccctcatggacctcatgttggtctgtaccaatgtgccaaagatggcagccaacttcctgtctggcaggaagtccatctcctttgtgggctgtggcatacaaattggcctctttgtctgtcttgtgggatctgaggggctcttgctgggactcatggcttatgaccgctatgtggccattagccacccacttcactatcccatcctcatgaatcagagggtctgtctccagattactgggagctcctgggcctttgggataatcgatggcttgatccagatggtggtagtaatgaatttcccctactgtggcttgaggaaggtgaaccatttcttctgtgagatgctatccttgttgaagctggcctgtgtagacacatccctgtttgagaaggtgatatttgcttgctgtgtcttcatgcttctcttcccattctccatcatcgtggcctcctatgctcacattctagggactgtgctgcaaatgcactctgctcaggcctggaaaaaggccctggccacctgctcctcccacctgacagctgtcaccctcttctatggggcagccatgttcatctacctgaggcctaggcactaccgggcccccagccatgacaaggtggcctctatcttctacacggtccttactcccatgctcaaccccctcatttacagcttgaggaacagggaggtgatgggggcactgaggaaggggctggaccgctgcaggatcggcagccagcactga

SEQ ID NO: 162217 - DNA, 1028 bp, Homo sapiens
  Payload ID: 11770
  Gene Symbol: OR2W1
  Gene Name: olfactory receptor, family 2, subfamily W, member 1
  Uniprot ID: Q9Y3N9
  ENST ID: ENST00000377175
  CDS Start-End: 66-1028
ccttgtatcatcatctacctcctcctcctccttttctcactctaggatttagacattgaaggactatggaccaaagcaattatagttctttacatggttttattctgcttggcttctctaaccatccaaaaatggagatgatcctgtcaggagttgtcgccatcttctacttaattacattggtgggtaacacagccatcattcttgcatctctcctggattcccagcttcatacaccaatgtactttttcctcagaaatttatctttcctagatctatgtttcacaaccagcatcatccctcagatgctggtcaacttgtggggacctgataagaccatcagctatgtgggttgtatcatccaactctatgtttacatgtggttgggctcagttgagtgccttctcctggctgttatgtcctatgatcgttttacagctatatgtaagcccttgcattattttgtagtcatgaacccacatctatgtctaaagatgattatcatgatctggagtattagtttggccaattctgtagtattatgtacactcactctgaatttgcccacatgtggaaacaacattctggatcatttcttgtgtgagttgccagctctggtcaagatagcttgtgtagacaccacaacagttgaaatgtctgttttcgctttaggcattataattgtcctcacacctctcatccttattcttatatcctatggctacattgccaaagctgtgctgagaacgaagtcaaaagcaagccagcgaaaagcaatgaatacctgtggatctcatcttactgtagtgtctatgttctatggaactattatctacatgtacctgcaaccaggtaacagggcttccaaagaccagggcaagttcctcaccctcttttacaccgtcatcactccaagtctcaacccgctcatttacaccttaagaaataaggacatgaaggatgccctgaagaaactgatgagatttcaccacaaatctacaaaaataaagaggaattgcaagtcatag

SEQ ID NO: 162218 - DNA, 1028 bp, Homo sapiens; identical to SEQ ID NO: 162217
  Payload ID: 11770
  Gene Symbol: OR2W1
  Gene Name: olfactory receptor, family 2, subfamily W, member 1
  Uniprot ID: Q9Y3N9
  ENST ID: ENST00000383654
  CDS Start-End: 66-1028

SEQ ID NO: 162219 - DNA, 1028 bp, Homo sapiens; identical to SEQ ID NO: 162217
  Payload ID: 11770
  Gene Symbol: OR2W1
  Gene Name: olfactory receptor, family 2, subfamily W, member 1
  Uniprot ID: Q9Y3N9
  ENST ID: ENST00000411447
  CDS Start-End: 66-1028

SEQ ID NO: 162220 - DNA, 1028 bp, Homo sapiens; identical to SEQ ID NO: 162217
  Payload ID: 11770
  Gene Symbol: OR2W1
  Gene Name: olfactory receptor, family 2, subfamily W, member 1
  Uniprot ID: Q9Y3N9
  ENST ID: ENST00000421766
  CDS Start-End: 66-1028

SEQ ID NO: 162221 - DNA, 1028 bp, Homo sapiens; identical to SEQ ID NO: 162217
  Payload ID: 11770
  Gene Symbol: OR2W1
  Gene Name: olfactory receptor, family 2, subfamily W, member 1
  Uniprot ID: Q9Y3N9
  ENST ID: ENST00000420540
  CDS Start-End: 66-1028

SEQ ID NO: 162222 - DNA, 1028 bp, Homo sapiens; identical to SEQ ID NO: 162217
  Payload ID: 11770
  Gene Symbol: OR2W1
  Gene Name: olfactory receptor, family 2, subfamily W, member 1
  Uniprot ID: Q9Y3N9
  ENST ID: ENST00000439723
  CDS Start-End: 66-1028

SEQ ID NO: 162223 - DNA, 1028 bp, Homo sapiens; identical to SEQ ID NO: 162217
  Payload ID: 11770
  Gene Symbol: OR2W1
  Gene Name: olfactory receptor, family 2, subfamily W, member 1
  Uniprot ID: Q9Y3N9
  ENST ID: ENST00000446776
  CDS Start-End: 66-1028

SEQ ID NO: 162224 - DNA, 1028 bp, Homo sapiens; identical to SEQ ID NO: 162217
  Payload ID: 11770
  Gene Symbol: OR2W1
  Gene Name: olfactory receptor, family 2, subfamily W, member 1
  Uniprot ID: Q9Y3N9
  ENST ID: ENST00000421027
  CDS Start-End: 66-1028

SEQ ID NO: 162225 - DNA, 945 bp, Homo sapiens
  Payload ID: 11771
  Gene Symbol: OR2W3
  Gene Name: olfactory receptor, family 2, subfamily W, member 3
  Uniprot ID: Q7Z3T1
  ENST ID: ENST00000360358
  CDS Start-End: 1-945
atggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacacccccatgtacttcttcctcgcccacctttccttcctggacctcagtttcaccaccagctccatcccccagctgctctacaaccttaatggatgtgacaagaccatcagctacatgggctgtgccatccagctcttcctgttcctgggtctgggtggtgtggagtgcctgcttctggctgtcatggcctatgaccggtgtgtggctatctgcaagcccctgcactacatggtgatcatgaaccccaggctctgccggggcttggtgtcagtgacctggggctgtggggtggccaactccttggccatgtctcctgtgaccctgcgcttaccccgctgtgggcaccacgaggtggaccacttcctgcgtgagatgcccgccctgatccggatggcctgcgtcagcactgtggccatcgaaggcaccgtctttgtcctggcggtgggtgttgtgctgtcccccttggtgtttatcctgctctcttacagctacattgtgagggctgtgttacaaattcggtcagcatcaggaaggcagaaggccttcggcacctgcggctcccatctcactgtggtctcccttttctatggaaacatcatctacatgtacatgcagccaggagccagttcttcccaggaccagggcatgttcctcatgctcttctacaacattgtcacccccctcctcaatcctctcatctacaccctcagaaacagagaggtgaagggggcactgggaaggttgcttctggggaagagagagctaggaaaggagtaa

SEQ ID NO: 162226 - DNA, 1058 bp, Homo sapiens
  Payload ID: 11772
  Gene Symbol: OR2Y1
  Gene Name: olfactory receptor, family 2, subfamily Y, member 1
  Uniprot ID: Q8NGV0
  ENST ID: ENST00000307832
  CDS Start-End: 42-977
ggcattgcacttccttctgctgttcagacaggcaaaaggccatgggaagtttcaacaccagttttgaagatggcttcattttggtgggattctcagattggccgcaactggagcccatcctgtttgtctttatttttattttctactccctaactctctttggcaacaccatcatcatcgctctctcctggctagaccttcggctgcacacacctatgtacttctttctctctcatctgtccctcctggacctctgcttcaccaccagcaccgtgccccagctcctgatcaacctttgcggggtggaccgcaccatcacccgtggagggtgtgtggctcagctcttcatctacctagccctgggctccacagagtgtgtgctcctggtggtgatggcctttgaccgctatgctgctgtctgtcgtccactccactacatggccatcatgcacccccatctctgccagaccctggctatcgcctcctggggtgcgggtttcgtgaactctctgatccagacaggtctcgcaatggccatgcctctctgtggccatcgactgaatcacttcttctgtgagatgcctgtatttctgaagttggcttgtgcggacacagaaggaacagaggccaagatgtttgtggcccgagtcatagtcgtggctgttcctgcagcacttattctaggctcctatgtgcacattgctcatgcagtgctgagggtgaagtcaacggctgggcgcagaaaggcttttgggacttgtgggtcccacctcctagtagttttccttttttatggctcagccatctacacatatctccaatccatccacaattattctgagcgtgagggaaaatttgttgcccttttttatactataattacccccattctcaatcctctcatttatacactaagaaacaaggacgtgaagggggctctgtggaaagtactatggaggggcagggactcagggtaggaggtgaaaaaatgagcagtaaaattttctgtaatagctcttcaatcacagatctttccctgttccttggagggcagttgg

SEQ ID NO: 162227 - DNA, 1056 bp, Homo sapiens
  Payload ID: 11773
  Gene Symbol: OR2Z1
  Gene Name: olfactory receptor, family 2, subfamily Z, member 1
  Uniprot ID: Q8NG97
  ENST ID: ENST00000324060
  CDS Start-End: 76-1020
ttatttgccaccccatgcaggcttcttgccatagttcagctgttcttcctgcagctaaagtgcattgtgtaaaacatgggggatgtgaatcagtcggtggcctcagacttcattctggtgggcctcttcagtcactcaggatcacgccagctcctcttctccctggtggctgtcatgtttgtcataggccttctgggcaacaccgttcttctcttcttgatccgtgtggactcccggctccacacacccatgtacttcctgctcagccagctctccctgtttgacattggctgtcccatggtcaccatccccaagatggcatcagactttctgcggggagaaggtgccacctcctatggaggtggtgcagctcaaatattcttcctcacactgatgggtgtggctgagggcgtcctgttggtcctcatgtcttatgaccgttatgttgctgtgtgccagcccctgcagtatcctgtacttatgagacgccaggtatgtctgctgatgatgggctcctcctgggtggtaggtgtgctcaacgcctccatccagacctccatcaccctgcattttccctactgtgcctcccgtattgtggatcacttcttctgtgaggtgccagccctactgaagctctcctgtgcagatacctgtgcctacgagatggcgctgtccacctcaggggtgctgatcctaatgctccctctttccctcatcgccacctcctacggccacgtgttgcaggctgttctaagcatgcgctcagaggaggccagacacaaggctgtcaccacctgctcctcgcacatcacggtagtggggctcttttatggtgccgccgtgttcatgtacatggtgccttgcgcctaccacagtccacagcaggataacgtggtttccctcttctatagccttgtcacccctacactcaacccccttatctacagtctgaggaatccggaggtgtggatggctttggtcaaagtgcttagcagagctggactcaggcaaatgtgctgactacatagaaactgctggtgagattccagcggtcct

SEQ ID NO: 162228 - DNA, 948 bp, Homo sapiens
  Payload ID: 11774
  Gene Symbol: OR3A1
  Gene Name: olfactory receptor, family 3, subfamily A, member 1
  Uniprot ID: P47881
  ENST ID: ENST00000323404
  CDS Start-End: 1-948
atgcagccagaatctggggccaatggaacagtcattgctgagttcatcctgctgggcttgctggaggcgccagggctgcagccagttgtctttgtgctcttcctctttgcctacctggtcacggtcaggggcaacctcagcatcctggcagctgtcttggtggagcccaaactccacacccccatgtacttcttcctggggaacctatcagtgctggatgttgggtgcatcagcgtcactgttccatcaatgttgagtcgtctcctgtcccgcaagcgtgcagttccctgtggggcctgccttacccagctcttcttcttccatctgttcgttggagtggactgcttcctgctgaccgccatggcctatgaccgattcctggccatctgccggcccctcacctacagcacccgcatgagtcagacagtccagaggatgttggtggctgcgtcctgggcttgtgctttcaccaacgcactgacccacactgtggccatgtccacgctcaacttctgtggccccaatgtgatcaatcacttctactgtgacctcccacagctcttccagctctcctgctccagcacccaactcaatgagctgctgctttttgctgtgggttttataatggcaggtacccccatggctctcattgtcatctcctatatccacgtggcagctgcagtcctgcgaattcgctctgtagagggcaggaagaaagccttctccacatgtggctcccacctcactgtggttgccatattctatggttcaggtatctttaactatatgcgactgggttcaaccaagctttcagacaaggataaagctgttggaattttcaacactgtcatcaatcccatgctgaacccaatcatctacagcttcagaaaccctgatgtgcagagtgccatctggaggatgctcacagggaggcggtcactggcttga

SEQ ID NO: 162229 - DNA, 966 bp, Homo sapiens
  Payload ID: 11774
  Gene Symbol: OR3A1
  Gene Name: olfactory receptor, family 3, subfamily A, member 1
  ENST ID: ENST00000615105
  CDS Start-End: 1-966
gtttctttgcaggaactcatgcagccagaatctggggccaatggaacagtcattgctgagttcatcctgctgggcttgctggaggcgccagggctgcagccagttgtctttgtgctcttcctctttgcctacctggtcacggtcaggggcaacctcagcatcctggcagctgtcttggtggagcccaaactccacacccccatgtacttcttcctggggaacctatcagtgctggatgttgggtgcatcagcgtcactgttccatcaatgttgagtcgtctcctgtcccgcaagcgtgcagttccctgtggggcctgccttacccagctcttcttcttccatctgttcgttggagtggactgcttcctgctgaccgccatggcctatgaccgattcctggccatctgccggcccctcacctacagcacccgcatgagtcagacagtccagaggatgttggtggctgcgtcctgggcttgtgctttcaccaacgcactgacccacactgtggccatgtccacgctcaacttctgtggccccaatgtgatcaatcacttctactgtgacctcccacagctcttccagctctcctgctccagcacccaactcaatgagctgctgctttttgctgtgggttttataatggcaggtacccccatggctctcattgtcatctcctatatccacgtggcagctgcagtcctgcgaattcgctctgtagagggcaggaagaaagccttctccacatgtggctcccacctcactgtggttgccatattctatggttcaggtatctttaactatatgcgactgggttcaaccaagctttcagacaaggataaagctgttggaattttcaacactgtcatcaatcccatgctgaacccaatcatctacagcttcagaaaccctgatgtgcagagtgccatctggaggatgctcacagggaggcggtcactggcttga

SEQ ID NO: 162230 - DNA, 1076 bp, Homo sapiens
  Payload ID: 11775
  Gene Symbol: OR3A2
  Gene Name: olfactory receptor, family 3, subfamily A, member 2
  Uniprot ID: P47893
  ENST ID: ENST00000408891
  CDS Start-End: 40-1005
taagtgaactgagtgaactgatacctcccctgctgggacatgtccttacagaaactcatggagccagaagctgggaccaataggaccgctgttgctgagttcattctactgggcctagtgcaaacagaagagatgcagccagttgtctttgtgctcctcctctttgcctatctggtcacaactgggggcaacctcagcatcctggcagccgtcttggtggagcccaaactccacgcccccatgtacttcttcctggggaacctgtcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtccttggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgctgtgggtttcatcatggcaggcacacctttggttctcatcatcactgcctacagccacgtggcagctgcagttctacgaatccgttcagtggagggccgaaagaaggccttctccacgtgtggctcccacctcaccgtggtttgtcttttctttggaagaggtatcttcaactacatgagactgggttcagaggaggcttcagacaaggataaaggggttggagttttcaacactgttatcaaccctatgctgaaccctcttatctacagcctcagaaaccctgatgttcagggtgctctgtggcaaatatttttggggaggagatcactgacctgagaggtaatggggtccctcctttcctgccttttctggactgaggaaaatttcccatgaagacagtaaccagg

SEQ ID NO: 162231 - DNA, 966 bp, Homo sapiens
  Payload ID: 11776
  Gene Symbol: OR3A3
  Gene Name: olfactory receptor, family 3, subfamily A, member 3
  Uniprot ID: P47888
  ENST ID: ENST00000291231
  CDS Start-End: 1-966
atgtccttacagaaactcatggagccagaagctgggaccaataggaccgctgttgctgagttcattctactgggcctagtgcaaacagaagagatgcagccagttgtctttgtgctcctcctctttgcctatctggtcacaactgggggcaacctcagcatcctggcagccgtcttggtggagcccaaactccacgcccccatgtacttcttcctggggaacctgtcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtcctgggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgtagcagcagccttcatggctgtggcacccttggtcttcatcagtgtgtcctatgcccatgtggtagctgctgtgctgcaaatccgctctgctgagggcagaaagaaggccttctccacatgtggctcccacctcactgtggtgggcatcttctatgggacaggtgtcttcagctacatgaggctgggttcagtggaatcttcagacaaggataagggggttggggttttcatgactgtgatcaaccccatgctgaacccacttatctacagcctcagaaatactgatgttcagggcgctctgtgtcagctacttgtggggaagcgatcactgacctga

SEQ ID NO: 162232 - DNA, 1035 bp, Homo sapiens
  Payload ID: 11777
  Gene Symbol: OR4A15
  Gene Name: olfactory receptor, family 4, subfamily A, member 15
  Uniprot ID: Q8NGL6
  ENST ID: ENST00000314706
  CDS Start-End: 1-1035
atggagcttctgacaaataatctcaaatttatcactgacccttttgtttgtaggctccgacacctgagtccaacaccttcagaagaacacatgaaaaataagaacaatgtgactgaatttatcctcttagggctcacacagaaccctgaggggcaaaaggttttatttgtcacattcttactaatctacatggtgacgataatgggcaacctgcttatcatagtgaccatcatggccagccagtccctgggttcccccatgtacttttttctggcttctttatcattcatagataccgtctattctactgcatttgctcccaaaatgattgttgacttgctctctgagaaaaagaccatttcctttcagggttgtatggctcaactttttatggatcatttatttgctggtgctgaagtcattcttctggtggtaatggcctatgatcgatacatggccatctgtaagcctcttcatgaattgatcaccatgaatcgtcgagtctgtgttcttatgctgttggcggcctggattggaggctttcttcactcattggttcaatttctctttatttatcagctccctttctgtggacccaatgtcattgacaacttcctgtgtgatttgtatcccttattgaaacttgcttgcaccaatacctatgtcactgggctttctatgatagctaatggaggagcgatttgtgctgtcaccttcttcactatcctgctttcctatggggtcatattacactctcttaagactcagagtttggaagggaaacgaaaagctttctacacctgtgcatcccacgtcactgtggtcattttattctttgtcccctgtatcttcttgtatgcaaggcccaattctacttttcccattgataaatccatgactgtagttctaacttttataactcccatgctgaacccactaatctataccctgaagaatgcagaaatgaaaagtgccatgaggaaactttggagtaaaaaagtaagcttagctgggaaatggctgtatcactcatga

SEQ ID NO: 162233 - DNA, 987 bp, Homo sapiens
  Payload ID: 11778
  Gene Symbol: OR4A16
  Gene Name: olfactory receptor, family 4, subfamily A, member 16
  Uniprot ID: Q8NH70
  ENST ID: ENST00000314721
  CDS Start-End: 1-987
atgagaccaagcagcaatgttacagaatttgtcctcctgggcctcactcaagatcctgatgtgaaaaaaacattatttgtcatgtttttactcatatacattgtgacaatggtgggaaacctcctcatttgggtgactactattggcagcccctccttgggctccctaatgtacttcttccttgcctacttgtcacttatggatgccatatattccactgccatgtcacccaaattgatgatagacttactctgtgataaaatcgctatttccttgtcagcttgcatgggtcagctcttcatagaacacttacttggtggtgcagaggtcttccttttggtggtgatggcctatgatcgctatgtggctatctctaagccgctgcactatttgaacatcatgaatcgactggtttgcatccttctgttggtggtggccatgattggaggttttgtgcactctgtggttcaaattgtctttctgtacagtctaccaatctgtggccccaatgttattgaccactctgtctgtgacatgtacccattgttggaactgttgtgccttgacacctactttataggactcactgtggttgccaatggtggaataatttgtatggtcatctttacctttctgctaatctcctgtggagtcatcctaaacttccttaaaacttacagtcaggaagagaggcataaagccctgcctacctgcatctcccacatcattgtggttgccctcgtttttgttccctgtatttttatgtatgttagacccgtttccaactttccctttgataaattaatgactgtgttttattcaattatcacactcatgttgaatcctttaatatactcgttgagacaatcagagatgaaaaatgctatgaaaaatctctggtgtgaaaagttaagtatagttagaaaaagagtatctcccacactgaacatatttattcctagttctaaggcaacaaataggcggtaa

SEQ ID NO: 162234 - DNA, 1064 bp, Homo sapiens
  Payload ID: 11779
  Gene Symbol: OR4A47
  Gene Name: olfactory receptor, family 4, subfamily A, member 47
  Uniprot ID: Q6IF82
  ENST ID: ENST00000446524
  CDS Start-End: 77-1006
tgcatttaaagatttccccccttgttttataggtaaactgcttatatgatctgaagtaagcagctgtaaagaatacatggagccaaggaaaaatgtgactgactttgtcctcttgggcttcacacagaatccaaaggagcagaaagtactttttgttatgttcttgctcttctacattttgaccatggtgggcaacctgctcattgtagtgaccgtaactgtcagtgagaccctgggctcaccaatgtacttctttcttgctggcttatcatttatagatatcatttattcttcatccatttcccccagattgatttcaggcttgttctttgggaataattccatatccttccaatcttgcatggcccagctctttatcgagcacattttcggtgggtcagaggtctttctcctgttggtgatggcctatgactgctatgtggccatctgtaagcccttgcattatttggttatcatgagacaatgggtgtgtgttgtgctgctggtagtgtcctgggttggaggatttctgcactcagtatttcaacttagcattatttatgggctcccattctgtggccccaatgtcattgatcattttttctgtgacatgtatcccttattgaaactggtctgcactgacacccatgctattggcctcttagtggtggccaatggaggactggcttgcactattgtgtttctgctcttactcatctcttatggtgtcatcttgcactctttaaagaaccttagtcagaaagggaggcaaaaagccctctcaacctgcagttcccacatgactgtggttgtcttcttctttgttccttgtatttttatgtatgctagacctgctaggaccttccccattgacaaatcagtgagtgtgttttatacagtcataaccccaatgctgaaccccttaatctacactctgagaaattctgagatgacaagtgctatgaagaagctctggagaagagacctcatatcaagtagtacataagtgagttacccaccaggaagagagtcatttgactttacagcctttctccttgggaccc

SEQ ID NO: 162235 - DNA, 948 bp, Homo sapiens
  Payload ID: 11780
  Gene Symbol: OR4A5
  Gene Name: olfactory receptor, family 4, subfamily A, member 5
  Uniprot ID: Q8NH83
  ENST ID: ENST00000319760
  CDS Start-End: 1-948
atgagacagaataacaatattacagaatttgtcctcctgggcttttctcaggatcctggtgtgcaaaaagcattatttgtcatgtttttactcacatacttggtgacagtggtggggaacctgctcattgtggtggatattattgccagcccttccttgggttccccaatgtatttcttccttgcctgcctgtcatttatagatgctgcatattccactaccatttctcccaagttaattgtaggcttattctgtgataaaaagactatttccttccaaggttgcatgggccagctatttatagaccatttctttggtggggctgaggtcttccttctggtggtgatggcctgtgatcgctatgtggccatctgtaagccactgcactatttgaccatcatgaatcgacaggtttgcttccttctgttggtggtggccatgattggaggttttgtacattctgcgtttcaaattgttgtgtacagtctccctttctgtggtcccaatgtcattgttcatttcagttgtgacatgcacccattactggaactggcatgcactgacacctactttataggcctcactgttgttgtcaatagtggagcaatctgtatggtcattttcaaccttctgttaatctcctatggagtcatcctaagctcccttaaaacttacagtcaggaaaagaggggtaaagccttgtctacctgcagctccggcagtaccgttgttgtcctcttttttgtaccctgtattttcatatatgttagacctgtttcaaactttcctactgataagttcatgactgtgttttataccattatcacacacatgctgagtcctttaatatatacgttgagaaattcagagatgagaaatgctatagaaaaactcttgggtaaaaagttaactatatttattataggaggagtgtccgtcctcatgtag

SEQ ID NO: 162236 - DNA, 945 bp, Homo sapiens
  Payload ID: 11781
  Gene Symbol: OR4A8
  Gene Name: olfactory receptor, family 4, subfamily A, member 8 (gene/pseudogene)
  ENST ID: ENST00000418689
  CDS Start-End: 1-945
atgaggcagaataacaatattacagaatttgtcctcctgggcttctctcagtatcctgatgtgcaaaatgcattatttgtcatgtttttactcatatatattgtgactatggtggggaacctgctcattgtggtgtctattattgccagtccctttttgggctccccagtgtacttcttccttgcctgcctgtcatttatagatgctgtgtattccaccaccatttctcctgtattgattgtagacttactctgtgataaaaagactatttccttcccagcttgcatgggtcagctatttatagagcacttgtttggtgatactgacgtcttccttctggtggtgatggcctatgatcgctacgtggccacctgtaagccactgcgctatttgaccatcatgaattgacaggtttgcatccttctgttggtggtggctgtgactggaggttttctgcattctgtgtttcaaattttagttgtgtacagtctccctttctgtggccccaatgtcatttatcactttttctgtaacatataccctttattggacctggaatgcactgacacctacttcgtaggcctcgctgtggttttcaatggtggagcaatctgtatggtcatcttcacccttctactaatctcctatggggtcatcctaaactcccttaaaacttatagtccggaagggaggcataaagctccgtttatctgcagctcccactttatcatggttatcttgttttttgttccctgtattttcttatatgttagacccgtttcaaactttcctattgataaattcctgactgtgttttattcagttatcacacccaagttgaatccttttatatacatgttgagaaattcagagatgagaaatgctatagaaaatctcttgggataccaaagtgggaagacaggatttagatgctccaagctcaat

SEQ ID NO: 162237 - DNA, 971 bp, Homo sapiens
  Payload ID: 11782
  Gene Symbol: OR4B1
  Gene Name: olfactory receptor, family 4, subfamily B, member 1
  Uniprot ID: Q8NGF8
  ENST ID: ENST00000309562
  CDS Start-End: 19-948
cttctctgagtggaatccatggccagtacaagtaatgtgactgagttgattttcactggccttttccaggatccagctgtgcagagtgtatgctttgtggtgtttctccccgtgtaccttgccacggtggtgggcaatggcctcatcgttctgacggtcagtatcagcaagagtctggattctcccatgtacttcttccttagctgcctgtccttggtggagatcagttattcctccactatcgcccctaaattcatcatagacttacttgccaagattaaaaccatctctctggaaggctgtctgactcagatattcttcttccacttctttggggttgctgagatccttttgattgtggtgatggcctatgattgctacgtggccatttgcaagcctcttcattatatgaacattatcagtcgtcaactgtgtcaccttctggtggctggttcctggctggggggcttttgtcactccataattcagattctcgttatcatccaattgcccttctgtggtcccaatgtgattgaccactatttctgtgacctccagcctttattcaagcttgcctgcactgacaccttcatggagggggttattgtgttggccaacagtggattattctctgtcttctccttcctcatcttggtgtcctcttatattgtcattctggtcaacttgaggaaccattctgcagaggggaggcacaaagccctctccacctgtgcttctcacatcacagtggtcatcttgttttttggacctgctatcttcctctacatgcgaccttcttccactttcactgaagataaacttgtggctgtattctacacggtcatcacccccatgctgaaccccatcatttacacactcaggaatgcagaggtgaaaatcgccataagaagattgtggagcaaaaaggagaatccagggagggagtgaaaaaagagcttagggatgaaaaa

SEQ ID NO: 162238 - DNA, 1045 bp, Homo sapiens
  Payload ID: 11783
  Gene Symbol: OR4C11
  Gene Name: olfactory receptor, family 4, subfamily C, member 11
  Uniprot ID: Q6IEV9
  ENST ID: ENST00000302231
  CDS Start-End: 26-958
tggtttcttcacatcaactgaaacaatgcagcaaaataacagtgtgcctgaattcatactgttaggattaacacaggatcccttgaggcagaaaatagtgtttgtaatcttcttaattttctatatgggaactgtggtggggaatatgctcattattgtgaccatcaagtccagccggacactaggaagccccatgtacttctttctattttatttgtcctttgcagattcttgcttttcaacttccacagcccctagattaattgtggatgctctctctgaaaagaaaattataacctacaatgagtgcatgacacaagtctttgcactacatttatttggctgcatggagatctttgtcctcattctcatggctgttgatcgctatgtggccatctgtaagcccttgcgttacccaaccatcatgagccagcaggtctgcatcatcctgattgttcttgcctggatagggtctttaatacactctacagctcagattatcctggccttaagattgcctttctgtggaccctatttgattgatcattattgctgtgatttgcagcccttgttgaaacttgcctgcatggacacttacatgatcaacctgctgttggtgtctaacagtggggcaatttgctcaagtagtttcatgattttgataatttcatatattgtcatcttgcattcactgagaaaccacagtgccaaagggaagaaaaaggctctctccgcttgcacgtctcacataattgtagtcatcttattctttggcccatgtatattcatatatacacgccccccgaccactttccccatggacaagatggtggcagtattttatactattggaacaccctttctcaatccactcatctacacactgaggaatgcagaagtgaaaaatgccatgagaaagttatggcatggcaaaattatttcagaaaacaaaggataaattgagggcctgacctgattactttttcagtcaaatcatgatttaacagagtaagtatagacagcaaataggaaagtacctgaatgc

SEQ ID NO: 162239 - DNA, 1063 bp, Homo sapiens
  Payload ID: 11784
  Gene Symbol: OR4C12
  Gene Name: olfactory receptor, family 4, subfamily C, member 12
  Uniprot ID: Q96R67
  ENST ID: ENST00000335238
  CDS Start-End: 35-964
ccttcctggaggttttatcacccacactacatagatggagaagaaaaagaatgtgactgaattcattttaataggtcttacacagaaccccataatggagaaagtcacgtttgtagtatttttggttctttacatgataacactttcaggcaacctgctcattgtggttaccattaccaccagccaggctctgagctcccccatgtacttcttcctgacccacctttctttgatagacacagtttattcttcttcttcagctcctaagttgattgtggattcctttcaagagaagaaaatcatctcctttaatgggtgtatggctcaagcctatgcagaacacatttttggtgctactgagatcatcctgctgacagtgatggcctgtgactgctatgtggccatctgcaaacctctgaactacacaaccattatgagccacagcctgtgcattctcctggtggcagtggcctgggtgggaggatttcttcatgcaactattcagattctctttacagtatggctgcccttctgtggccccaatgtcataggccacttcatgtgtgacttgtacccattgttaaaacttgtttgcatagacactcatacccttggtctctttgttgctgtgaacagtgggtttatctgcttattaaacttccttatcttggtggtatcctatgtgatcatcttgagatctttaaagaacaatagcttggaggggaggtgtaaagccctctccacctgtatttctcacatcatagtagttgtcttattctttgtgccctgtatatttgtgtatctgcgctcagtgaccactctgcccattgataaagctgttgctgtattttatactatggtggtcccaatgttaaatcccgtggtctacacactcagaaatgctgaggtaaaaagtgcaataaggaagctttggagaaaaaaagtgacttcagataatgattaaataagaccattgagcactcaacatagaggtaataggtatttaagcttcttgatttgtagatgaatatgtcaactctaacaaggggctggctaatgcttg

SEQ ID NO: 162240 - DNA, 1029 bp, Homo sapiens
  Payload ID: 11785
  Gene Symbol: OR4C13
  Gene Name: olfactory receptor, family 4, subfamily C, member 13
  Uniprot ID: Q8NGP0
  ENST ID: ENST00000555099
  CDS Start-End: 33-962
caggtaatgtaattaaccatcatttgaaatacatggcgaatagaaacaatgtgacagagtttattctattggggcttacagagaatccaaaaatgcagaaaatcatatttgttgtgttttctgtcatctacatcaacgccatgataggaaatgtgctcattgtggtcaccatcactgccagcccatcactgagatcccccatgtactttttcctggcctatctctcctttattgatgcctgctattcctctgtcaatacccctaagctgatcacagattcactctatgaaaacaagactatcttattcaatggatgtatgactcaagtctttggagaacattttttcagaggtgttgaggtcatcctacttactgtaatggcctatgaccactatgtggccatctgcaagcccttgcactataccaccgtcatgaagcagcatgtttgtagcctgctagtgggagtgtcatgggtaggaggctttcttcatgcaaccatacagatcctcttcatctgtcaattacctttctgtggtcctaatgtcatagatcactttatgtgtgatctctacactttgatcaatcttgcctgcactaatacccacactctaggactcttcattgctgccaacagtgggttcatatgcctgttaaactgtctcttgctcctggtctcctgcgtggtcatactgtactccttaaagacccacagcttagaggcaaggcacgaagccctctctacctgtgtctcccacatcacagttgtcatcttatcctttataccctgcatatttgtgtacatgagacctccagctactttacccattgataaagcagttgctgtattctacactatgataacttctatgttaaaccccttaatctacaccttgaggaatgctcaaatgaaaaatgccattaggaaattgtgtagtaggaaagctatttcaagtgtcaaataaatgtgactggagcccaacatgattcagctgaggcaagggtcaaaaggacattttgggtaatgccagc

SEQ ID NO: 162241 - DNA, 1113 bp, Homo sapiens
  Payload ID: 11786
  Gene Symbol: OR4C15
  Gene Name: olfactory receptor, family 4, subfamily C, member 15
  Uniprot ID: Q8NGM1
  ENST ID: ENST00000314644
  CDS Start-End: 1-1113
atgttctcaatgacaacagaagcactcaataattttgcacttggatgtaccaacttgttaatgactatgataccacaaattgatctgaagcaaattttcctttgtcctaattgcagactatacatgatccctgttggagctttcatcttttccttgggaaacatgcaaaaccaaagctttgtaactgagtttgtcctcctgggactttcacagaatccaaatgttcaggaaatagtatttgttgtatttttgtttgtctacattgcaactgttgggggcaacatgctaattgtagtaaccattctcagcagccctgctcttctggtgtctcctatgtacttcttcttgggcttcctgtccttcctggatgcgtgcttctcatctgtcatcaccccaaagatgattgtagactccctctatgtgacaaaaaccatctcttttgaaggctgcatgatgcagctctttgctgaacacttctttgctggggtggaggtgattgtcctcacagccatggcctatgatcgttatgtggccatttgcaagcccttgcattactcttctatcatgaacaggaggctctgtggcattctgatgggggtagcctggacagggggcctcttgcattccatgatacaaattctttttactttccagcttcccttttgtggccccaatgtcatcaatcactttatgtgtgacttgtacccgttactggagcttgcctgcactgatactcacatctttggcctcatggtggtcatcaacagtgggtttatctgcatcataaacttctccttgttgcttgtctcctatgctgtcatcttgctctctctgagaacacacagttctgaagggcgctggaaagctctctccacctgtggatctcacattgctgttgtgattttgttctttgtcccatgcatatttgtatatacacgacctccatctgctttttcccttgacaaaatggcggcaatattttatatcatcttaaatcccttgctcaatcctttgatttacactttcaggaataaggaagtaaaacaggccatgaggagaatatggaacagactgatggtggtttctgatgagaaagaaaatattaaactttaa

SEQ ID NO: 162242 - DNA, 933 bp, Homo sapiens; identical to SEQ ID NO: 161882
  Payload ID: 11787
  Gene Symbol: OR4C16
  Gene Name: olfactory receptor, family 4, subfamily C, member 16 (gene/pseudogene)
  Uniprot ID: Q8NGL9
  ENST ID: ENST00000314634
  CDS Start-End: 1-933

SEQ ID NO: 162243 - DNA, 1036 bp, Homo sapiens
  Payload ID: 11788
  Gene Symbol: OR4C3
  Gene Name: olfactory receptor, family 4, subfamily C, member 3
  Uniprot ID: Q8NH37
  ENST ID: ENST00000319856
  CDS Start-End: 22-1011
aacttgcaatgtttttcccccatgcaattagttctattacttatgtttctccttgtctttataggcaatactgcacctgcattctcagtgaccttggaatctatggacataccacaaaatatcacagaatttttcatgctggggctctcacagaactcagaggtacagagagttctctttgtggtctttttgctgatctatgtggtcacggtttgtggcaacatgctcattgtggtcactatcacctccagccccacgctggcttcccctgtgtattttttcctggccaacctatcctttattgacaccttttattcttcttctatggctcctaaactcattgctgactcattgtatgaggggagaaccatctcttatgagtgctgcatggctcagctctttggagctcattttttgggaggtgttgagatcattctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaatgccatgagaaagctctttacatggtaagaaattgcaggtggaaaatgagtgg

SEQ ID NO: 162244 - DNA, 597 bp, Homo sapiens
  Payload ID: 11788
  Gene Symbol: OR4C3
  Gene Name: olfactory receptor, family 4, subfamily C, member 3
  ENST ID: ENST00000611380
  CDS Start-End: 1-597
attctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaatgccatgagaaagctctttacatgcataatgtcttccagggaaaag

SEQ ID NO: 162245 - DNA, 930 bp, Homo sapiens
  Payload ID: 11789
  Gene Symbol: OR4C46
  Gene Name: olfactory receptor, family 4, subfamily C, member 46
  Uniprot ID: A6NHA9
  ENST ID: ENST00000328188
  CDS Start-End: 1-930
atggagaataggaataacatgacagagtttgttttgctggggcttacagagaatccaaagatgcagaaaatcatatttgttgtgttttttgtcatctatatcatcactgtggtgggatatgtgctcattgtggtcaccatcactgccagcccatcactggggtcccccatgtacctttccctggcctatctctcctttattgatgcctgctattcctctgtcaatacccctaacctgatcacacattcactctatggaaagaaggccatcctattcaatggatgcatgactcaagtctttggagaacatttcttcggaggtgcagagggcatcctacttactgtgatggcctatgaccactatgtggccatctgcaagcccttgcactatatgactatcatgaaccagtgtgtgtgtgccctgctaatgggagtggtgtggatgggaggctttcttcatgcaaccatacagatcctcttcatcttccaattacctttctgtggtcctaatgtcatagatcactttatgtgtgatctgaaccctttgctcaacctcgcctgcactgacacccatatgctggaactcttcattgctgccaacagtggattcatctgcttgttaaactttgccctcctgctggtctcctatgtggtcatcttgtgctccctaaggactcatagcttggaggcaaggcacaaagccctctccacctgtgtctcccacatcacggttgtcatcttattctttgtgccctgcatatttgtgtacatgagacctgcagctactttacctattgataaagcagttgctatattctacactatgataactcctatgttaaaccccttaatctataccttgaagaatgcccagatgaaaaatgccatcaggaaattgtgtagtagaaaggacatttcaggtgacaaataa

SEQ ID NO: 162246 - DNA, 981 bp, Homo sapiens
  Payload ID: 11790
  Gene Symbol: OR4C5
  Gene Name: olfactory receptor, family 4, subfamily C, member 5 (gene/pseudogene)
  Uniprot ID: Q8NGB2
  ENST ID: ENST00000319813
  CDS Start-End: 1-981
atgtatgtgtcaaattgcaatccttgtgctattcacagaaaaatcaattatccaaataccaaactggatttcgagcaagtgaacaacataacggaattcatcttgcttggcctgacacagaacgcagaggcacagaaactcttgtttgctgtgtttacactcatctactttctcaccatggtagacaacctaatcattgtggtgacaatcaccaccagcccagccctggactcccccgtgtatttttttctgtctttcttttccttcatagatggctgctcctcttctaccatggcccccaaaatgatatttgacttactcactgaaaagaaaactatttccttcagtgggtgcatgacccagctctttgtagaacatttctttgggggagttgagatcattctgctcgtggtgatggcctatgactgctatgtggccatctgcaagcccctgtactacctgatcacaatgaacaggcaggtatgtggcctcctggtggccatggcatgggtcgggggatttcttcacgctctgattcaaatgcttttaatagtctggctgcccttctgtggccccaatgtcattgaccatttcatctgtgaccttttccctctgctaaaactctcctgcactgacactcacgtctttggactctttgttgccgccaacagtgggctgatgtgtatgctcattttttctattcttattacctcttacgtcctaatcctctgctcacagcggaaggctctctctacctgcgccttccatatcactgtagtcgtcctattctttgttccctgtatattggtgtaccttcgacccatgatcaccttccctattgataaagctgtgtctgtgttttatactgtggtaacacccatgttaaaccctttaatctacaccctcagaaacacagaggtgaaaaatgccatgaagcagctctggagccaaataatctggggtaacaatttgtgtgattag

SEQ ID NO: 162247 - DNA, 930 bp, Homo sapiens
  Payload ID: 11791
  Gene Symbol: OR4C6
  Gene Name: olfactory receptor, family 4, subfamily C, member 6
  Uniprot ID: Q8NH72
  ENST ID: ENST00000314259
  CDS Start-End: 1-930
atggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataa

SEQ ID NO: 162248 - DNA, 1024 bp, Homo sapiens
  Payload ID: 11792
  Gene Symbol: OR4D1
  Gene Name: olfactory receptor, family 4, subfamily D, member 1
  Uniprot ID: Q15615
  ENST ID: ENST00000268912
  CDS Start-End: 22-954
aggaacgtgggggaagatcctatggaaccacagaacaccacacaggtatcaatgtttgtcctcttagggttttcacagacccaagagctccagaaattcctgttccttctgttcctgttagtctatgttaccaccattgtgggaaacctccttatcatggtcacagtgacttttgactgccggctccacacacccatgtattttctgctccgaaatctagctctcatagacctctgctattccacagtcacctctccaaagatgctggtggacttcctccatgagaccaagacgatctcctaccagggctgcatggcccagatcttcttcttccaccttttgggaggtgggactgtcttttttctctcagtcatggcctatgaccgctacatagccatctcccagcccctccggtatgtcaccatcatgaacactcaattgtgtgtgggcctggtagtagccgcctgggtggggggctttgtccactccattgtccaactggctctgatacttccactgcccttctgtggccccaatatcctagataacttctactgtgatgttccccaagtactgagacttgcctgcactgatacctccctcctggagttcctcatgatctccaacagtgggctgctagttatcatctggttcctcctccttctgatctcttatactgtcatcctggtgatgctgaggtcccactcgggaaaggcaaggaggaaggcagcttccacctgcaccacccacatcatcgtggtgtccatgatcttcattccctgtatctatatctatacctggcccttcaccccattcctcatggacaaggctgtgtccatcagctacacagtcatgacccccatgctcaaccccatgatctacaccctgagaaaccaggacatgaaagcagccatgaggagattaggcaagtgcctagtaatttgcagggagtaaactttaagtaagttgactttaaatgacaaatttctctggatttttattttcccacatgaaaaatggagga

SEQ ID NO: 162249 - DNA, 1024 bp, Homo sapiens
  Payload ID: 11793
  Gene Symbol: OR4D10
  Gene Name: olfactory receptor, family 4, subfamily D, member 10
  Uniprot ID: Q8NGI6
  ENST ID: ENST00000530162
  CDS Start-End: 58-993
tcccagtgctttcacatgacatggtttaaaaccaaagagaataaagaggatgattgaatggagatggaaaactgcaccagggtaaaagaatttattttccttggcctgacccagaatcgggaagtgagcttagtcttatttcttttcctactcttggtgtatgtgacaactttgctgggaaacctcctcatcatggtcactgttacctgtgaatctcgccttcacacgcccatgtattttttgctccataatttatctattgccgatatctgcttctcttccatcacagtgcccaaggttctggtggaccttctgtctgaaagaaagaccatctccttcaatcattgcttcactcagatgtttctattccaccttattggaggggtggatgtattttctctttcggtgatggcattggatcgatatgtggccatctccaagcccctgcactatgcgactatcatgagtagagaccattgcattgggctcacagtggctgcctggttggggggctttgtccactccatcgtgcagatttccctgttgctcccactccctttctgcggacccaatgttcttgacactttctactgtgatgtccaccgggtcctcaaactggcccatacagacattttcatacttgaactactaatgatttccaacaatggactgctcaccacactgtggtttttcctgctcctggtgtcctacatagtcatattatcattacccaagtctcaggcaggagagggcaggaggaaagccatctccacctgcacctcccacatcactgtggtgaccctgcatttcgtgccctgcatctatgtctatgcccggcccttcactgccctccccatggataaggccatctctgtcaccttcactgtcatctcccctctgctcaaccccttgatctacactctgaggaaccatgagatgaagtcagccatgaggagactgaagagaagacttgtgccttctgatagaaaatagaaaaaaaaatcctcagctcttcatcaccaaa

SEQ ID NO: 162250 - DNA, 936 bp, Homo sapiens
  Payload ID: 11794
  Gene Symbol: OR4D11
  Gene Name: olfactory receptor, family 4, subfamily D, member 11
  Uniprot ID: Q8NGI4
  ENST ID: ENST00000313253
  CDS Start-End: 1-936
atggagttgggaaatgtcaccagagtaaaagaatttatatttctgggacttactcaatcccaagaccagagtttggtcttgtttctttttttatgtcttgtgtacatgacgactctgctgggaaacctcctcatcatggtcaccgtgacctgtgagtctcgccttcacacccccatgtacttcctgctccgcaatctagccatccttgacatctgcttctcctccacaactgctcctaaagtcttgctggaccttctgtcaaagaaaaagaccatatcctatacaagctgcatgacacagatatttctcttccacctccttggtggggcagacattttttctctctctgtgatggcgtttgactgctacatggccatctccaagcccctgcactatgtgaccatcatgagtagagggcaatgcactgccctcatctctgcctcttggatggggggctttgtccactccatcgtgcagatctccctgttgctgcctctccctttctgtggacccaatgttcttgacactttctactgcgatgtcccccaggtcctcaaactcacttgcactgacacttttgctcttgagttcttgatgatttccaacaatggcctggtcactaccctgtggtttatcttcctgcttgtgtcctacacagtcatcctaatgacgctgaggtctcaggcaggagggggcaggaggaaagccatctccacttgcacctcccacatcactgtggtgaccctgcattttgtgccctgcatctatgtctatgcccggcccttcactgccctccccacagaaaaggccatctctgtcaccttcactgtcatctcccctctgctgaaccctttgatctacactctgaggaaccaggaaatgaagtcagccatgagaagactgaagagaagactcgtgccttctgaaagggaatag

SEQ ID NO: 162251 - DNA, 924 bp, Homo sapiens
  Payload ID: 11795
  Gene Symbol: OR4D2
  Gene Name: olfactory receptor, family 4, subfamily D, member 2
  Uniprot ID: P58180
  ENST ID: ENST00000545221
  CDS Start-End: 1-924
atggaaacagggaacctcacgtgggtatcagactttgtcttcctggggctctcgcagactcgggagctccagcgtttcctgtttctaatgttcctgtttgtctacatcaccactgttatgggaaacatccttatcatcatcacagtgacctctgattcccagctccacacacccatgtactttctgctccgaaacctggctgtcctagacctctgtttctcttcagtcactgctcccaaaatgctagtggacctcctctctgagaagaaaaccatctcttaccagggctgcatgggtcagatcttcttcttccactttttgggaggtgccatggtcttcttcctctcagtgatggcctttgaccgcctcattgccatctcccggcccctccgctatgtcaccgtcatgaacactcagctctgggtggggctggtggtagccacctgggtgggaggctttgtccactctattgtccagctggctctgatgctcccactgcccttctgtggccccaacattttggataacttctactgtgatgttccccaagtactgagacttgcctgcactgacacctcactgctggagttcctcaagatctccaacagtgggctgctggatgtcgtctggttcttcctcctcctgatgtcctacttattcatcctggtgatgctgaggtcacatccaggggaggcaagaaggaaggcagcttccacctgcaccacccacatcatcgtggtttccatgatcttcgttccaagcatttacctctatgcccggcccttcactccattccctatggacaagcttgtgtccatcggccacacagtcatgacccccatgctcaaccccatgatctataccctgaggaaccaggacatgcaggcagcagtgagaagattagggagacaccggctggtttga

SEQ ID NO: 162252 - DNA, 1095 bp, Homo sapiens
  Payload ID: 11796
  Gene Symbol: OR4D5
  Gene Name: olfactory receptor, family 4, subfamily D, member 5
  Uniprot ID: Q8NGN0
  ENST ID: ENST00000307033
  CDS Start-End: 75-1031
gagaactttgcagatcccctgaataatatgtccttttttcttagcaggttcattgacaaggtcataccaaccagatgaatccagcaaatcattcccaggtggcaggatttgttctactggggctctctcaggtttgggagcttcggtttgttttcttcactgttttctctgctgtgtattttatgactgtagtgggaaaccttcttattgtggtcatagtgacctccgacccacacctgcacacaaccatgtattttctcttgggcaatctttctttcctggacttttgctactcttccatcacagcacctaggatgctggttgacttgctctcaggcaaccctaccatttcctttggtggatgcctgactcaactcttcttcttccacttcattggaggcatcaagatcttcctgctgactgtcatggcgtatgaccgctacattgccatttcccagcccctgcactacacgctcattatgaatcagactgtctgtgcactccttatggcagcctcctgggtggggggcttcatccactccatagtacagattgcattgactatccagctgccattctgtgggcctgacaagctggacaacttttattgtgatgtgcctcagctgatcaaattggcctgcacagatacctttgtcttagagcttttaatggtgtctaacaatggcctggtgaccctgatgtgttttctggtgcttctgggatcgtacacagcactgctagtcatgctccgaagccactcacgggagggccgcagcaaggccctgtctacctgtgcctctcacattgctgtggtgaccttaatctttgtgccttgcatctacgtctatacaaggccttttcggacattccccatggacaaggccgtctctgtgctatacacaattgtcacccccatgctgaatcctgccatctataccctgagaaacaaggaagtgatcatggccatgaagaagctgtggaggaggaaaaaggaccctattggtcccctggagcacagacccttacattagcagaggcagtgacctgagaatctgaaagatgctacagggtattagcctgctggataggaccctc

SEQ ID NO: 162253 - DNA, 1054 bp, Homo sapiens
  Payload ID: 11797
  Gene Symbol: OR4D6
  Gene Name: olfactory receptor, family 4, subfamily D, member 6
  Uniprot ID: Q8NGJ1
  ENST ID: ENST00000300127
  CDS Start-End: 24-968
cctggaagagagtcatccccatcatggaccagatcaaccacactaatgtgaaggagtttttcttcctggaacttacacgttcccgagagctggagtttttcttgtttgtggtcttctttgctgtgtatgtagcaacagtcctgggaaatgcactcattgtggtcactattacctgtgagtcccgcctacacactcctatgtactttctcctgcggaacaaatcagtcctggacatcgttttttcatctatcaccgtccccaagttcctggtggatcttttatcagacaggaaaaccatctcctacaatgactgcatggcacagatctttttcttccactttgctggtggggcagatatttttttcctctctgtgatggcctatgacagataccttgcaatcgccaagcccctgcactatgtgaccatgatgaggaaagaggtgtgggtggccttggtggtggcttcttgggtgagtggtggtttgcattcaatcatccaggtaattctgatgcttccattccccttctgtggccccaacacactggatgccttctactgttatgtgctccaggtggtaaaactggcctgcactgacacctttgctttggagcttttcatgatctctaacaacggactggtgaccctgctctggttcctcctgctcctgggctcctacactgtcattctggtgatgctgagatcccactctggggaggggcggaacaaggccctctccacgtgcacgtcccacatgctggtggtgactcttcacttcgtgccttgtgtttacatctactgccggcccttcatgacgctgcccatggacacaaccatatccattaataacacggtcattacccccatgctgaaccccatcatctattccctgagaaatcaagagatgaagtcagccatgcagaggctgcagaggagacttgggccttccgagagcagaaaatgggggtgagcagtcagatggagagtggaagtctgtctgacttagttttctcaaaatgctagcctaagagtaacaggtcgctagctcttcttcca

SEQ ID NO: 162254 - DNA, 945 bp, Homo sapiens
  Payload ID: 11798
  Gene Symbol: OR4D9
  Gene Name: olfactory receptor, family 4, subfamily D, member 9
  Uniprot ID: Q8NGE8
  ENST ID: ENST00000329328
  CDS Start-End: 1-945
atggatcagagaaattacaccagagtgaaagaatttaccttcctgggaattactcagtcccgagaactgagccaggtcttatttaccttcctgtttttggtgtacatgacaactctaatgggaaacttcctcatcatggttacagttacctgtgaatctcaccttcatacgcccatgtacttcctgctccgcaacctgtctattcttgacatctgcttttcctccatcacagctcctaaggtcctgatagatcttctatcagagacaaaaaccatctccttcagtggctgtgtcactcaaatgttcttcttccaccttctggggggagcagacgttttttctctctctgtgatggcgtttgaccgctatatagccatctccaagcccctgcactatatgaccatcatgagtagggggcgatgcacaggcctcatcgtggcttcctgggtggggggctttgtccactccatagcgcagatttctctattgctcccactccctttctgtggacccaatgttcttgacactttctactgcgatgtcccccaggtcctcaaacttgcctgcactgacaccttcactctggagctcctgatgatttcaaataatgggttagtcagttggtttgtattcttctttctcctcatatcttacacggtcatcttgatgatgctgaggtctcacactggggaaggcaggaggaaagccatctccacctgcacctcccacatcaccgtggtgaccctgcatttcgtgccctgcatctatgtctatgcccggcccttcactgccctccccacagacactgccatctctgtcaccttcactgtcatctcccctttgctcaatcctataatttacacgctgaggaatcaggaaatgaagttggccatgaggaaactgaagagacggctaggacaatcagaaaggattttaattcaataa

SEQ ID NO: 162255 - DNA, 942 bp, Homo sapiens
  Payload ID: 11799
  Gene Symbol: OR4E2
  Gene Name: olfactory receptor, family 4, subfamily E, member 2
  Uniprot ID: Q8NGC2
  ENST ID: ENST00000408935
  CDS Start-End: 1-942
atggacagtctaaaccaaacaagagtgactgaatttgtcttcttgggactcactgataaccgggtgctggaaatgctgtttttcatggcattctcagccatttatatgctaacgctttcggggaacattctcatcatcattgccacagtctttactccaagtctccatacccccatgtatttcttcctgagcaatctgtcctttattgacatctgccactcatctgtcactgtgcctaagatgttggagggtttgcttttagaaagaaagaccatttcctttgacaactgcatcacacagctcttcttcctacatctctttgcctgtgccgagatctttctgctgatcattatggcgtatgatcgttacgtggctatctgcactccactccactaccccaatgtgatgaacatgagagtctgtatacagcttgtctttgctctctggttggggggtactgttcactcactagggcagaccttcttgactattcgtctaccttactgtggccccaacattattgacagctacttctgtgatgtgcctcttgttatcaagctggcctgcacagatacatacctcacaggaatactgattgtgaccaatagtggaaccatctccctctcctgtttcttggccgtggtcacctcctatatggtcatcctggtttctcttcgaaaacactcagctgaagggcgccggaaagccctgtctacctgctcggcccacttcatggtggttgccctcttctttgggccatgtatcttcatctatactcggccagacaccagcttctccattgacaaggtggtgtctgtcttctacacagtggtcacccctttgctgaatcccttcatttacaccttgaggaatgaggaggtaaaaagtgccatgaagcagctcaggcagagacaagtttttttcacgaaatcatatacataa

SEQ ID NO: 162256 - DNA, 985 bp, Homo sapiens
  Payload ID: 11800
  Gene Symbol: OR4F15
  Gene Name: olfactory receptor, family 4, subfamily F, member 15
  Uniprot ID: Q8NGB8
  ENST ID: ENST00000332238
  CDS Start-End: 25-963
aaactgatcttggagtctgaggcaatgaatggaatgaatcactctgtggtatcagaatttgtattcatgggactcaccaactcacgggagattcagcttctactttttgttttctctttgttgttctactttgcgagcatgatgggaaaccttgtcattgtattcactgtaaccatggatgctcatctgcactcccccatgtatttcctcctggctaacctctcaatcattgatatggcattttgctcaattacagcccctaagatgatttgtgatattttcaagaagcacaaggccatctcctttcggggatgtattactcagatcttctttagccatgctcttgggggcactgagatggtgctgctcatagccatggcctttgacagatacatggccatatgtaaacctctccactacctgaccatcatgagcccaagaatgtgtctatactttttagccacttcctctatcattggccttatccactcattggtccaattagtttttgtggtagatttacctttttgtggtcctaatatctttgacagtttttactgtgatctccctcggctcctcagacttgcctgtaccaacacccaagaactggagttcatggtcactgtcaatagtggactcatttctgtgggctcctttgtcttgctggtaatttcctacatcttcattctgttcactgtttggaaacattcttctggtggtctagccaaggccctctctaccctgtcagctcatgtcactgtggtcatcttgttctttgggccactgatgtttttctacacatggccttctcccacatcacacctggataaatatcttgctatttttgatgcatttattactccttttctgaatccagttatctacacattcaggaacaaagacatgaaagtggcaatgaggagactgtgcagtcgtcttgcgcattttacaaagattttgtaaatggcttggctgtcaagatgtg

SEQ ID NO: 162257 - DNA, 927 bp, Homo sapiens
  Payload ID: 11800
  Gene Symbol: OR4F15
  Gene Name: olfactory receptor, family 4, subfamily F, member 15
  ENST ID: ENST00000536946
  CDS Start-End: 1-927
atggatgaagccaatcactctgtggtctctgagtttgtgttcctgggactctctgactcgcggaagatccagctcctcctcttcctctttttctcagtgttctatgtgtcaagcctgatgggaaatctcctcattgtgctaactgtgacctctgaccctcgtttacagtcccccatgtacttcctgctggccaacctttccatcatcaatttggtattttgttcctccacagctcccaagatgatttatgaccttttcaggaagcacaagaccatctcttttgggggctgtgtagttcagatcttctttatccatgcagttgggggaactgagatggtgctgctcatagccatggcttttgaccgatatgtggccatatgtaagcctctccactacctgaccatcatgagcccaagaatgtgtctatactttttagccacttcctctatcattggccttatccactcattggtccaattagtttttgtggtagatttacctttttgtggtcctaatatctttgacagtttttactgtgatctccctcggctcctcagacttgcctgtaccaacacccaagaactggagttcatggtcactgtcaatagtggactcatttctgtgggctcctttgtcttgctggtaatttcctacatcttcattctgttcactgtttggaaacattcttctggtggtctagccaaggccctctctaccctgtcagctcatgtcactgtggtcatcttgttctttgggccactgatgtttttctacacatggccttctcccacatcacacctggataaatatcttgctatttttgatgcatttattactccttttctgaatccagttatctacacattcaggaacaaagacatgaaagtggcaatgaggagactgtgcagtcgtcttgcgttttacaaa

SEQ ID NO: 162258 - DNA, 939 bp, Homo sapiens
  Payload ID: 11801
  Gene Symbol: OR4F16
  Gene Name: olfactory receptor, family 4, subfamily F, member 16
  Uniprot ID: Q6IEY1
  ENST ID: ENST00000332831
  CDS Start-End: 1-939
atggatggagagaatcactcagtggtatctgagtttttgtttctgggactcactcattcatgggagatccagctcctcctcctagtgttttcctctgtgctctatgtggcaagcattactggaaacatcctcattgtgttttctgtgaccactgaccctcacttacactcccccatgtactttctactggccagtctctccttcattgacttaggagcctgctctgtcacttctcccaagatgatttatgacctgttcagaaagcgcaaagtcatctcctttggaggctgcatcgctcaaatcttcttcatccacgtcgttggtggtgtggagatggtgctgctcatagccatggcctttgacagatatgtggccctatgtaagcccctccactatctgaccattatgagcccaagaatgtgcctttcatttctggctgttgcctggacccttggtgtcagtcactccctgttccaactggcatttcttgttaatttagccttctgtggccctaatgtgttggacagcttctactgtgaccttcctcggcttctcagactagcctgtaccgacacctacagattgcagttcatggtcactgttaacagtgggtttatctgtgtgggtactttcttcatacttctaatctcctacgtcttcatcctgtttactgtttggaaacattcctcaggtggttcatccaaggccctttccactctttcagctcacagcacagtggtccttttgttctttggtccacccatgtttgtgtatacacggccacaccctaattcacagatggacaagtttctggctatttttgatgcagttctcactccttttctgaatccagttgtctatacattcaggaataaggagatgaaggcagcaataaagagagtatgcaaacagctagtgatttacaagaggatctcataa

SEQ ID NO: 162259 - DNA, 1054 bp, Homo sapiens
  Payload ID: 11802
  Gene Symbol: OR4F17
  Gene Name: olfactory receptor, family 4, subfamily F, member 17
  Uniprot ID: Q8NGA8
  ENST ID: ENST00000318050
  CDS Start-End: 37-954
tcctggaatgaatcaacgagtgaaacgaataactctatggtgactgaattcatttttctgggtctctctgattctcagggactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaaacccctacactacactacaattatgtgtggcaacgcatgtgtcggcattatggctgtcgcatggggaattggctttctccattcggtgagccagttggcctttgccgtgcacttacccttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcatcgccctttagataagtcgtccaaagctctgtccactttgactgctcacattacagtagttcttttgttctttggaccatgtgtctttatttatgcctggccattccccatcaagtcattagataaattccttgctgtattttattctgtgatcacccctctcttgaacccaattatatacacactgaggaacaaagacatgaagacggcaataagacagctgagaaaatgggatgcacattctagtgtaaagttttagatcttatataactgtgagattaatctcagataatgacacaaaatatagtgaagttggtaagttatttagtaaagctcatgaaaattgtgccctccattcc

SEQ ID NO: 162260 - DNA, 1167 bp, Homo sapiens
  Payload ID: 11802
  Gene Symbol: OR4F17
  Gene Name: olfactory receptor, family 4, subfamily F, member 17
  Uniprot ID: Q8NGA8
  ENST ID: ENST00000585993
  CDS Start-End: 150-1067
atctttccccaggtccggtgttttcttacccacctccttccctcctttttataataccagtgaaacttggtttggagcatttctttcacataaaggtaactgcagaggctatttcctggaatgaatcaacgagtgaaacgaataactctatggtgactgaattcatttttctgggtctctctgattctcagggactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaaacccctacactacactacaattatgtgtggcaacgcatgtgtcggcattatggctgtcgcatggggaattggctttctccattcggtgagccagttggcctttgccgtgcacttacccttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcatcgccctttagataagtcgtccaaagctctgtccactttgactgctcacattacagtagttcttttgttctttggaccatgtgtctttatttatgcctggccattccccatcaagtcattagataaattccttgctgtattttattctgtgatcacccctctcttgaacccaattatatacacactgaggaacaaagacatgaagacggcaataagacagctgagaaaatgggatgcacattctagtgtaaagttttagatcttatataactgtgagattaatctcagataatgacacaaaatatagtgaagttggtaagttatttagtaaagctcatgaaaattgtgccctccattcc

SEQ ID NO: 162261 - DNA, 995 bp, Homo sapiens
  Payload ID: 11803
  Gene Symbol: OR4F21
  Gene Name: olfactory receptor, family 4, subfamily F, member 21
  Uniprot ID: O95013
  ENST ID: ENST00000320901
  CDS Start-End: 20-958
agcccagttggctggaccaatggatggagagaatcactcagtggtatctgagtttttgtttctgggactcactcattcatgggagatccagctcctcctcctagtgttttcctctgtgctctatgtggcaagcattactggaaacatcttcattgtgttttctgtgaccactgaccctcacttacactcccccatgtactttctactggccagtctctccttcattgacttaggagcctgctctgtcacttctcccaagatgatttatgacctgttcagaaagcgcaaagtcatctcctttggaggctgcatcgctcaaatcttcttcatccacgtcattggtggtgtggagatggtgctgctcatagccatggcctttgacagatatgtggccctatgtaagcccctccactatctgaccattatgagcccaagaatgtgcctttcatttctggctgttgcctggacccttggtgtcagtcactccctgttccaactggcatttcttgttaatttagccttctgtggccctaatgtgttggacagcttctactgtgaccttcctcggcttctcagactagcctgtaccgacacctacagattgcagttcatggtcactgttaacagtgggtttatctgtgtgggtactttcttcatacttctaatctcctacgtcttcatcctgtttactgtttggaaacattcctcaggtggttcatccaaggccctttccactctttcagctcacagcacagtggtccttttgttctttggtccacccatgtttgtgtatacacggccacaccctaattcacagatggacaagtttctggctatttttgatgcagttctcactccttttctgaatccagttgtctatacattcaggaataaggagatgaaggcagcaataaagagagtatgcaaacagctagtgatttacaagaagatctcataaatgatacaataagcccttctcgttaaacatgatatgg

SEQ ID NO: 162262 - DNA, 939 bp, Homo sapiens; identical to SEQ ID NO: 162258
  Payload ID: 11804
  Gene Symbol: OR4F29
  Gene Name: olfactory receptor, family 4, subfamily F, member 29
  Uniprot ID: Q6IEY1
  ENST ID: ENST00000426406
  CDS Start-End: 1-939

SEQ ID NO: 162263 - DNA, 995 bp, Homo sapiens
  Payload ID: 11805
  Gene Symbol: OR4F3
  Gene Name: olfactory receptor, family 4, subfamily F, member 3
  Uniprot ID: Q6IEY1
  ENST ID: ENST00000456475
  CDS Start-End: 20-958
agcccagttggctggaccaatggatggagagaatcactcagtggtatctgagtttttgtttctgggactcactcattcatgggagatccagctcctcctcctagtgttttcctctgtgctctatgtggcaagcattactggaaacatcctcattgtgttttctgtgaccactgaccctcacttacactcccccatgtactttctactggccagtctctccttcattgacttaggagcctgctctgtcacttctcccaagatgatttatgacctgttcagaaagcgcaaagtcatctcctttggaggctgcatcgctcaaatcttcttcatccacgtcgttggtggtgtggagatggtgctgctcatagccatggcctttgacagatatgtggccctatgtaagcccctccactatctgaccattatgagcccaagaatgtgcctttcatttctggctgttgcctggacccttggtgtcagtcactccctgttccaactggcatttcttgttaatttagccttctgtggccctaatgtgttggacagcttctactgtgaccttcctcggcttctcagactagcctgtaccgacacctacagattgcagttcatggtcactgttaacagtgggtttatctgtgtgggtactttcttcatacttctaatctcctacgtcttcatcctgtttactgtttggaaacattcctcaggtggttcatccaaggccctttccactctttcagctcacagcacagtggtccttttgttctttggtccacccatgtttgtgtatacacggccacaccctaattcacagatggacaagtttctggctatttttgatgcagttctcactccttttctgaatccagttgtctatacattcaggaataaggagatgaaggcagcaataaagagagtatgcaaacagctagtgatttacaagaggatctcataaatgatataataagcccttctcattaaacatgatatgg

SEQ ID NO: 162264 - DNA, 1054 bp, Homo sapiens
  Payload ID: 11806
  Gene Symbol: OR4F4
  Gene Name: olfactory receptor, family 4, subfamily F, member 4
  Uniprot ID: Q96R69
  ENST ID: ENST00000326183
  CDS Start-End: 37-954
tcctggaatgaatcaacgagtgaaacgaataactctatggtgactgaattcatttttctgggtctctctgattctcaggaactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaaacccctacactacactacaattatgtgtggcaacgcatgtgtcggcattatggctgtcgcatggggaattggctttctccattcggtgagccagttggcctttgccgtgcacttacccttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcattgccctttagataagtcgtccaaagctctgtccactttgactgctcacattacagtagttcttttgttctttggaccatgtgtctttatttatgcctggccattccccatcaagtcattagataaattccttgctgtattttattctgtgatcacccctctcttgaacccaattatatacacactgaggaacaaagacatgaagacggcaataagacggctgagaaaatgggatgcacattctagtgtaaagttttagatcttatataactgtgagattaatctcagataatgacacaaaatatagtgaagttggtaagttatttagtaaagctcatgaaaattgtgccctccattcc

SEQ ID NO: 162265 - DNA, 918 bp, Homo sapiens
  Payload ID: 11807
  Gene Symbol: OR4F5
  Gene Name: olfactory receptor, family 4, subfamily F, member 5
  Uniprot ID: Q8NH21
  ENST ID: ENST00000335137
  CDS Start-End: 1-918
atggtgactgaattcatttttctgggtctctctgattctcaggaactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaagcccctacactacactacaattatgtgtggcaacgcatgtgtcggcattatggctgtcacatggggaattggctttctccattcggtgagccagttggcgtttgccgtgcacttactcttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcatcgccctttagataagtcgtccaaagctctgtccactttgactgctcacattacagtagttcttttgttctttggaccatgtgtctttatttatgcctggccattccccatcaagtcattagataaattccttgctgtattttattctgtgatcacccctctcttgaacccaattatatacacactgaggaacaaagacatgaagacggcaataagacagctgagaaaatgggatgcacattctagtgtaaagttttag

SEQ ID NO: 162266 - DNA, 988 bp, Homo sapiens
  Payload ID: 11808
  Gene Symbol: OR4F6
  Gene Name: olfactory receptor, family 4, subfamily F, member 6
  Uniprot ID: Q8NGB9
  ENST ID: ENST00000328882
  CDS Start-End: 22-960
ttgtcacagccgacagaggcaatggatgaagccaatcactctgtggtctctgagtttgtgttcctgggactctctgactcgcggaagatccagctcctcctcttcctctttttctcagtgttctatgtgtcaagcctgatgggaaatctcctcattgtgctaactgtgacctctgaccctcgtttacagtcccccatgtacttcctgctggccaacctttccatcatcaatttggtattttgttcctccacagctcccaagatgatttatgaccttttcaggaagcacaagaccatctcttttgggggctgtgtagttcagatcttctttatccatgcagttgggggaactgagatggtgctgctcatagccatggcttttgaccgatatgtggccatatgtaagcctctccactacctgaccatcatgaacccacaaaggtgcattttgtttttagtcatttcctggattataggtattattcactcagtgattcagttggcttttgttgtagacctgctgttctgtggccctaatgaattagatagtttcttttgtgatcttcctcgatttatcaaactggcttgcatagagacctacacattgggattcatggttactgccaatagtggatttatttctctggcttcttttttaattctcataatctcttacatctttattttggtgactgttcagaaaaaatcttcaggtggtatattcaaggctttctctatgctgtcagctcatgtcattgtggtggttttggtctttgggccattaatctttttctatatttttccatttcccacatcacatcttgataaattccttgccatctttgatgcagttatcactcccgttttgaatccagtcatctatacttttagaaataaagagatgatggtggcaatgagaagacgatgctctcagtttgtgaattacagtaaaatcttttaaatatattgagaatatacaaaaaggcaaa

SEQ ID NO: 162267 - DNA, 1076 bp, Homo sapiens
  Payload ID: 11809
  Gene Symbol: OR4K1
  Gene Name: olfactory receptor, family 4, subfamily K, member 1
  Uniprot ID: Q8NGD4
  ENST ID: ENST00000285600
  CDS Start-End: 60-995
tgccaatcattgtgacatttttctgatttcttttttttaggtaactgaatattggatacatggctcacacaaatgaatcgatggtgtctgagtttgtacttttgggactctctaattcctggggacttcaacttttcttttttgccatcttctctatagtctatgtgacatcagtgctaggcaatgtcttaattattgtcattatttcttttgactcccatttgaactctcctatgtacttcttgctcagtaatctttctttcattgatatctgtcagtctaactttgccacccccaagatgcttgtagacttttttattgagcgcaagactatctcctttgagggttgcatggcccagatattcgttcttcacagttttgttgggagtgagatgatgttgcttgtagctatggcatatgacagatttatagccatatgtaagcctctgcactacagtacaattatgaaccggaggctctgtgtaatttttgtgtctatttcctgggcggtgggcgttcttcattctgtgagccacttggcttttacagtggacctgccattctgtggtcccaatgaggtggatagcttcttttgtgaccttcccttggtgatagagctggcttgcatggatacatatgaaatggaaattatgaccctaacgaacagtggcctgatatcattgagctgtttcctggctttaattatttcctacaccatcattttgatcggtgtccgatgcaggtcctccagtgggtcatctaaggctctttctacattaactgcccacatcacagtggtcattcttttcttcgggccttgcatttatttctatatatggccttttagcagacttcctgtggacaaatttctttctgtgttctacactgtttgtactcccttgttgaaccccatcatctactctctgaggaatgaagatgttaaagcagccatgtggaagctgagaaaccgtcatgtgaactcctggaaaaactagggatcattacgaaggagcataatcctgaattagaatgaagaccctccagtgtatcatagtgtcatgccaaccatctttgcc

SEQ ID NO: 162268 - DNA, 917 bp, Homo sapiens
  Payload ID: 11810
  Gene Symbol: OR4K13
  Gene Name: olfactory receptor, family 4, subfamily K, member 13
  Uniprot ID: Q8NH42
  ENST ID: ENST00000315693
  CDS Start-End: 3-917
atatggaaagagcaaaccattcagtggtatcggaatttattttgttgggactttccaaatctcaaaatcttcagattttattcttcttgggattctctgtggtcttcgtggggattgtgttaggaaacctgctcatcttggtgactgtgacctttgattcgctccttcacacaccaatgtattttctgcttagcaacctctcctgcattgatatgatcctggcttcttttgctacccctaagatgattgtagatttcctccgagaacgtaagaccatctcatggtggggatgttattcccagatgttctttatgcacctcctgggtgggagtgagatgatgttgcttgtagccatggcaatagacaggtatgttgccatatgcaaacccctccattacatgaccatcatgagcccacgggtgctcactgggctactgttatcctcctatgcagttggatttgtgcactcatctagtcaaatggctttcatgttgactttgcccttctgtggtcccaatgttatagacagctttttctgtgaccttccccttgtgattaaacttgcctgcaaggacacctacatcctacagctcctggtcattgctgacagtgggctcctgtcactggtctgcttcctcctcttgcttgtctcctatggagtcataatattctcagttaggtaccgtgctgctagtcgatcctctaaggctttctccactctctcagctcacatcacagttgtgactctgttctttgctccgtgtgtctttatctacgtctggcccttcagcagatactcggtagataaaattctttctgtgttttacacaattttcacacctctcttaaatcctattatttatacattaagaaatcaagaggtaaaagcagccattaaaaaaagactctgcatataa

SEQ ID NO: 162269 - DNA, 934 bp, Homo sapiens
  Payload ID: 11811
  Gene Symbol: OR4K14
  Gene Name: olfactory receptor, family 4, subfamily K, member 14
  Uniprot ID: Q8NGD5
  ENST ID: ENST00000305045
  CDS Start-End: 1-933
atggacccacagaactattccttggtgtcagaatttgtgttgcatggactctgcacttcacgacatcttcaaaattttttctttatatttttctttggggtctatgtggccattatgctgggtaaccttctcattttggtcactgtaatttctgatccctgcctgcactcctcccctatgtacttcctgctggggaacctagctttcctggacatgtggctggcctcatttgccactcccaagatgatcagggatttccttagtgatcaaaaactcatctcctttggaggatgtatggctcaaatcttcttcttgcactttactggtggggctgagatggtgctcctggtttccatggcctatgacagatatgtggccatatgcaaacccttgcattacatgactttgatgagttggcagacttgcatcaggctggtgctggcttcatgggtcgttggatttgtgcactccatcagtcaagtggctttcactgtaaatttgccttactgtggccccaatgaggtagacagcttcttctgtgacctccctctggtgatcaaacttgcctgcatggacacctatgtcttgggtataattatgatctcagacagtgggttgctttccttgagctgttttctgctcctcctgatctcctacaccgtgatcctcctcgctatcagacagcgtgctgccggtagcacatccaaagcactctccacttgctctgcacatatcatggtagtgacgctgttctttggcccttgcatttttgtttatgtgcggcctttcagtaggttctctgtggacaagctgctgtctgtgttttataccatttttactccactcctgaaccccattatctacacattgagaaatgaggagatgaaagcagctatgaagaaactgcaaaaccgacgggtgacttttcaatgaa

SEQ ID NO: 162270 - DNA, 1216 bp, Homo sapiens
  Payload ID: 11812
  Gene Symbol: OR4K15
  Gene Name: olfactory receptor, family 4, subfamily K, member 15
  Uniprot ID: Q8NH41
  ENST ID: ENST00000305051
  CDS Start-End: 76-1122
tgaaaacccagacacatacatagcaataggaattggaattctgaaaagtttaagtgtaattggaaaatcaaacccatgctcacttcattaactgatctctgtttctctcctattcaggtagctgaaattaagtcccttccaaaatcgatgaatgagacaaatcattctcgggtgacagaatttgtgttgctgggactgtctagttcaagggagctccaacctttcttgtttcttacattttcactactttatctagcaattctgttgggcaactttctcatcatcctcactgtgacctcagattcccgccttcacacccccatgtactttctgcttgcaaacctgtcatttatagacgtatgtgttgcctcttttgctacccctaaaatgattgcagactttctggttgagcgcaagactatttcttttgatgcctgcctggcccagattttctttgttcatctcttcactggcagtgaaatggtgctcctagtttccatggcctatgaccgttatgttgctatatgcaaacctctccactacatgacagtcatgagccgtcgtgtatgtgttgtgctcgtcctcatttcatggtttgtgggcttcatccatactaccagccagttggcattcactgttaatctgccattttgtggtcctaataaggtagacagttttttctgtgaccttcctctagtgaccaagttagcctgcatagacacttatgttgtcagcttactaatagttgcagatagtggctttctttctctgagttcctttctcctcttggttgtctcctacactgtaatacttgttacagttaggaatcgctcctctgcaagcatggcgaaggcccgctccacattgactgctcacatcactgtggtcactttattctttggaccatgcattttcatctatgtgtggcccttcagcagttactcagttgacaaagtccttgctgtattctacaccatcttcacgcttattttaaaccctgtaatctacacgctaagaaacaaagaagtgaaggcagctatgtcaaaactgaagagtcggtatctgaagcctagtcaggtttctgtagtcataagaaatgttcttttcctagaaacaaagtaaacttatgagactgttaccactttagccctgtctccatacacttacaagtggattcactgtaatcttaaagcaaatcaacttggcctgtgggaaa

SEQ ID NO: 162271 - DNA, 1032 bp, Homo sapiens
  Payload ID: 11813
  Gene Symbol: OR4K17
  Gene Name: olfactory receptor, family 4, subfamily K, member 17
  Uniprot ID: Q8NGC6
  ENST ID: ENST00000315543
  CDS Start-End: 1-1032
atggctctttatttttcactcatactccatggtatgagtgatcttttctttctctctacaggtcatccaagagcgagctgtaggatggaggccatgaaactattaaatcaatctcaagtgtcagaattcattttgctgggactgaccagctcccaggatgtagagtttcttctctttgccctcttctcggttatctatgtggtcacagttttgggtaaccttcttattatagtcacagtgtttaacacccctaacctgaatactcccatgtattttctccttggtaatctctcttttgtagatatgacccttgcttcttttgccacccctaaggtgattctgaacttgttaaaaaagcagaaggtaatttcttttgctgggtgcttcactcagatatttctccttcacttactgggtggggttgaaatggtactgttggtctccatggcttttgacagatatgtggccatttgtaagcccctacactacatgaccatcatgaacaagaaggtatgtgttttgcttgtagtgacctcatggctcttgggtctccttcactcagggtttcagataccatttgctgtgaacttgcccttttgtggtcccaatgtggtagacagcattttttgtgacctccctttggttactaagcttgcctgtatagacatatattttgtacaggtagtcattgttgccaacagtggcataatctccctgagctgtttcattattttgcttatctcctacagtctgatcctcataaccattaagaaccactctcctactgggcaatctaaagcccgttccactttgactgctcacatcacagtggtgattctcttctttggcccatgcatctttatctacatttggcccttcggcaaccactctgtagataagttccttgctgtgttttataccatcatcactcctatcttgaatccaattatctatactctgagaaacaaagaaatgaagatatccatgaaaaaactctggagagcttttgtgaattctagagaagatacttag

SEQ ID NO: 162272 - DNA, 1078 bp, Homo sapiens
  Payload ID: 11814
  Gene Symbol: OR4K2
  Gene Name: olfactory receptor, family 4, subfamily K, member 2
  Uniprot ID: Q8NGD2
  ENST ID: ENST00000298642
  CDS Start-End: 37-981
tttcgtgatacaggcttctgcctatgaatcaagacaatggatgtgggcaataagtctaccatgtctgaatttgttttgctggggctctctaattcctgggaactacagatgtttttctttatggtgttttcattgctttatgtggcaacaatggtgggtaacagcctcatagtcatcacagttatagtggaccctcacctacactctcctatgtatttcctgcttaccaatctttcaatcattgatatgtctcttgcttctttcgccaccccaaagatgattacagattacctaacaggtcacaaaaccatctcttttgatggctgccttacccagatattctttctccaccttttcactggaactgagatcatcttactcatggccatgtcctttgataggtatattgcaatatgcaagcccctgcactatgcttctgtcattagtccccaggtgtgtgttgctctcgtggtggcttcctggattatgggagttatgcattcaatgagtcaggtcatatttgccctcacgttaccattctgtggtccctatgaggtagacagctttttctgtgaccttcctgtggtgttccagttggcttgtgtggatacttatgttctgggcctctttatgatctcaacaagtggcataattgcgttgtcctgttttattgttttatttaattcatatgttattgtcctggttactgtgaagcatcattcttccagaggatcatctaaggccctttctacttgtacagctcatttcattgttgtcttcttgttctttgggccatgcatcttcatctacatgtggccactaagcagctttctcacagacaagattctgtctgtgttttataccatctttactcccactctgaacccaataatctatactttgaggaatcaagaagtaaagatagccatgaggaaactgaaaaataggtttctaaattttaataaggcaatgccttcatagtttttgtgacacagaacattagacacaatgctgtgttaggcttttctttctagagggttcttaccaaattgtaattgccaagaatttgtgagggctc

SEQ ID NO: 162273 - DNA, 1078 bp, Homo sapiens
  Payload ID: 11815
  Gene Symbol: OR4K5
  Gene Name: olfactory receptor, family 4, subfamily K, member 5
  Uniprot ID: Q8NGD3
  ENST ID: ENST00000315915
  CDS Start-End: 26-997
cagaacaagtttgcagcttggaaccatggataagtccaattcttcagtggtgtctgaatttgtactgttgggactctgtagttctcaaaaactccagcttttctatttttgtttcttctctgtgttgtatacagtcattgtgctgggaaatcttctcattatcctcacagtgacttctgataccagcctgcactcccctatgtactttctcttgggaaacctttcctttgttgacatttgtcaggcttcttttgctacccctaaaatgattgcagattttctgagtgcacacgagaccatatctttcagtggctgcatagcccaaattttctttattcacctttttactggaggggagatggtgctacttgtttcgatggcctatgacaggtatgtagccatatgcaaacccttatactatgtggtcatcatgagccgaaggacatgcactgtcttggtaatgatctcctgggctgtgagcttggtgcacacattaagccagttatcatttactgtgaacctgcctttttgtggacctaatgtagtagacagctttttttgtgatcttcctcgagtcaccaaacttgcctgcctggactcttacatcattgaaatactaattgtggtcaatagtggaattctttccctaagcactttctctctcttggtcagctcctacatcattattcttgttacagtttggctcaagtcttcagctgcaatggcaaaggcattttctacgctggcttcccatattgcagtagtaatattattctttggaccttgcatcttcatctatgtgtggccctttaccatctctcctttggataaatttcttgccatattttacactgttttcacccccgtcctaaaccccattatttatacactaaggaatagggatatgaaggctgccgtaaggaaaattgtgaaccattacctgaggccaaggagaatttctgaaatgtcactagtagtgagaacttcctttcattaagacaaaactccttcaaattcctcaggtcaatacactgtttaatattttaatgtatttttgtggtgtatctcaattgtgggg

SEQ ID NO: 162274 - DNA, 939 bp, Homo sapiens
  Payload ID: 11816
  Gene Symbol: OR4L1
  Gene Name: olfactory receptor, family 4, subfamily L, member 1
  Uniprot ID: Q8NH43
  ENST ID: ENST00000315683
  CDS Start-End: 1-939
atggatcttaaaaatggatctctagtgaccgagtttattttactaggattttttggacgatgggaacttcaaattttcttctttgtgacattttccctgatctacggtgctactgtgatgggaaacattctcattatggtcacagtgacatgtaggtcaacccttcattctcccttgtactttctccttggaaatctctcttttttggacatgtgtctctccactgccacaacacccaagatgatcatagatttgctcactgaccacaagaccatctctgtgtggggctgcgtgacccagatgttcttcatgcacttctttgggggtgctgagatgactcttctgataatcatggcctttgacaggtatgtagccatatgtaaacccctgcactataggacaatcatgagccacaagctgctaaaggggtttgcgatactttcatggataattggttttttacactccataagccagatagttttaacaatgaacttgcctttctgtggccacaatgtcataaacaacatattttgtgatcttccccttgtgatcaagcttgcttgcattgaaacatacaccctggaattatttgtcattgctgacagcgggctgctctctttcacctgtttcatcctcttgcttgtttcttacattgtcatcctggtcagtgtaccaaaaaaatcatcacatgggctctccaaggcgctgtccacattgtctgcccacatcattgtggtcactctgttctttggaccttgtatttttatctatgtttggccattcagtagtttggcaagcaataaaactcttgccgtattttatacagttatcacacccttactgaatccgagtatttataccctgagaaataagaaaatgcaagaggccataagaaaattacggttccaatatgttagttctgcacagaatttctag

SEQ ID NO: 162275 - DNA, 1116 bp, Homo sapiens
  Payload ID: 11817
  Gene Symbol: OR4M1
  Gene Name: olfactory receptor, family 4, subfamily M, member 1
  Uniprot ID: Q8NGD0
  ENST ID: ENST00000315957
  CDS Start-End: 82-1023
aactctagataaatgctatgtggactaattatagtttctttaattttcatagttatattatgaaaagagtaaattgaagaaatggaaactgcaaattacaccaaggtgacagaatttgttctcactggcctatcccagactcgggaggtccaactagtcctatttgttatatttctatccttctatttgttcatcctaccaggaaatatccttatcatttgcaccatcaggctagaccctcatctgacttctcctatgtatttcctgttggctaatctggccctccttgatatttggtactcttccattacagcccctaaaatgctcatagacttctttgtggagaggaagataatttcctttggtggatgcattgcacagctcttcttcttacactttgttggggcttcggagatgttcttgctcacagtgatggcctatgaccgctatgctgctatctgccgacccctccactatgctaccatcatgaatcgacgtctctgctgtatcctggtggctctctcctggatggggggcttcattcattctataatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttcattgctctgttaatgtcctatgccttccttctggccttgctcaagaaacattcaggctcaggtgagaataccaacagggccatgtccacctgctattcccacattaccattgtggtgctaatgtttgggccatccatctacatttatgctcgcccatttgactcattttccctagataaagtggtgtctgtgtttcatactgtaatattccctttacttaatcccattatttacacattgagaaacaaggaagtaaaggcagccatgaggaaggtggtcaccaaatatattttgtgtgaagagaagtgaaagataaattatacattttatagtcctcctgaggatcattgtcctaaagcaggaagtatttgcagtaataatgctgcattcacttcctccgtt

SEQ ID NO: 162276 - DNA, 1133 bp, Homo sapiens
  Payload ID: 11818
  Gene Symbol: OR4M2
  Gene Name: olfactory receptor, family 4, subfamily M, member 2
  Uniprot ID: Q8NGB6
  ENST ID: ENST00000614722
  CDS Start-End: 99-1040
ttttgaaagcagtgatataactctaggtaaatgctatgtctactaattatagtttcttaattttcatagctatattatgaaaagagtaaattgaagaaatggaaactgcaaattacaccaaggtgacagaatttgttctcactggcctatcccagactccagaggtccaactagtcctatttgttatatttctatccttctatttgttcatcctaccaggaaatatccttatcatttgcaccatcagtctagaccctcatctgacctctcctatgtatttcctgttggctaatctggccttccttgatatttggtactcttccattacagcccctgaaatgctcatagacttctttgtggagaggaagataatttcttttgatggatgcattgcacagctcttcttcttacactttgctggggcttcggagatgttcttgctcacagtgatggcctttgacctctacactgctatctgccgacccctccactatgctaccatcatgaatcaacgtctctgctgtatcctggtggctctctcctggagggggggcttcattcattctatcatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttgattgctctgttaatgtcctatgccttccttctggccttgttcaagaaactttcaggctcaggtgagaataccaacagggccatgtccacctgctattcccacattaccattgtggtgctaatgtttgggccatccatctacatttatgctcgcccatttgactcgttttccctagataaagtggtgtctgtgttcaatactttaatattccctttacgtaatcccattatttacacattgagaaacaaggaagtaaaggcagccatgaggaagttggtcaccaaatatattttgtgtaaagagaagtgaaagataaattatacattttatagttcccctgaggatcattgtcctaaagcaggaagtatttgcagtaataatgctgcattgacttcctccttt

SEQ ID NO: 162277 - DNA, 924 bp, Homo sapiens
  Payload ID: 11819
  Gene Symbol: OR4N2
  Gene Name: olfactory receptor, family 4, subfamily N, member 2
  Uniprot ID: Q8NGD1
  ENST ID: ENST00000315947
  CDS Start-End: 1-924
atggaaagcgagaacagaacagtgataagagaattcatcctccttggtctgacccagtctcaagatattcagctcctggtctttgtgctagttttaatattctacttcatcatcctccctggaaattttctcattattttcaccataaagtcagaccctgggctcacagcccccctctatttctttctgggcaacttggccttcctggatgcatcctactccttcattgtggctccccggatgttggtggacttcctctctgcgaagaagataatctcctacagaggctgcatcactcagctctttttcttgcacttccttggaggaggggagggattactccttgttgtgatggcctttgaccgctacatcgccatctgccggcctctgcactatcctactgtcatgaaccctagaacctgctatgcaatgatgttggctctgtggcttgggggttttgtccactccattatccaggtggtcctcatcctccgcttgcctttttgtggcccaaaccagctggacaacttcttctgtgatgtcccacaggtcatcaagctggcctgcaccgacacatttgtggtggagcttctgatggtcttcaacagtggcctgatgacactcctgtgctttctggggcttctggcctcctatgcagtcattctttgtcgcatacgagggtcttcttctgaggcaaaaaacaaggccatgtccacgtgcatcacccatatcattgttatattcttcatgtttggacctggcatcttcatctacacgcgccccttcagggctttcccagctgacaaggtggtttctctcttccacacagtgatttttcctttgttgaatcctgtcatttatacccttcgcaaccaggaagtgaaagcttccatgaaaaaggtgtttaataagcacatagcctga

SEQ ID NO: 162278 - DNA, 565 bp, Homo sapiens
  Payload ID: 11819
  Gene Symbol: OR4N2
  Gene Name: olfactory receptor, family 4, subfamily N, member 2
  ENST ID: ENST00000557414
  CDS Start-End: 501-565
tattaaactttaatgggtagctggtagacaattaacactctgggagggctcaaaccacataaccaaatgtgccaagataatcctgagctcactcattgtcagtcctgaagattttcctcagagaatctttcatctctttgctcctgagactatatattagaggattacagagtggtgttatcacagaatagaacaagtggatttttatctgagatctacaacttaagaagaatataagtgatgtatattctcttctactcttcatgtatggaatagaggggcttgcacagtagactcaagagaattgacatctggtgttaaaaaccaaaaatcatacaaatgactgatatgtatcattttccttattaaatatggaagaaaagggaggaggatgcagaaatggtaggctaaaagctccagagaaaaacttaacagattttatgattttgcagaagataagtccttgacctcttcattttcacattcagcaggccagggaaatggaaagcgagaacagaacagtgataagagaattcatcctccttggtctgacccagtctcaaga

SEQ ID NO: 162279 - DNA, 522 bp, Homo sapiens
  Payload ID: 11819
  Gene Symbol: OR4N2
  Gene Name: olfactory receptor, family 4, subfamily N, member 2
  ENST ID: ENST00000557677
  CDS Start-End: 85-522
aggaaaggtactagctcttctttatgcatctggtagaactcagctgtgaattcctgtgatcctgggctttttctggccagggaaatggaaagcgagaacagaacagtgataagagaattcatcctccttggtctgacccagtctcaagatattcagctcctggtctttgtgctagttttaatattctacttcatcatcctccctggaaattttctcattattttcaccataaagtcagaccctgggctcacagcccccctctatttctttctgggcaacttggccttcctggatgcatcctactccttcattgtggctccccggatgttggtggacttcctctctgcgaagaagataatctcctacagaggctgcatcactcagctctttttcttgcacttccttggaggaggggagggattactccttgttgtgatggcctttgaccgctacatcgccatctgccggcctctgcactatcctactgtcatgaaccctagaacctgctatgcaatgatgttg

SEQ ID NO: 162280 - DNA, 1126 bp, Homo sapiens
  Payload ID: 11820
  Gene Symbol: OR4N4
  Gene Name: olfactory receptor, family 4, subfamily N, member 4
  Uniprot ID: Q8N0Y3
  ENST ID: ENST00000328795
  CDS Start-End: 92-1042
tgtggcataccttgtgtttagttcaagaactataatctagatgtaacacctgaaaataaactcttttattgatattctacaggcagaagaaatgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttatttctgggcaacttggccttcctggatgcatcctactccttcattgtggctcccaggatgttggtggacttcctctctgagaaaaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctaatggtcttcaacagtggcctgatgacactcctgtgctttctggggcttctggcttcctatgcagtcatcctctgccatgttcgtagggcagcttctgaagggaagaacaaggccatgtccacgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactgagtacctcccatttgccaggtacca

SEQ ID NO: 162281 - DNA, 927 bp, Homo sapiens
  Payload ID: 11821
  Gene Symbol: OR4N5
  Gene Name: olfactory receptor, family 4, subfamily N, member 5
  Uniprot ID: Q8IXE1
  ENST ID: ENST00000333629
  CDS Start-End: 1-927
atggaaacacagaacctcacagtggtgacagaattcattcttcttggtctgacccagtctcaagatgctcaacttctggtctttgtgctagtcttaattttctaccttatcatcctccctggaaatttcctcatcattttcaccataaagtcagaccctgggctcacagcccccctctatttctttctgggcaacttggccttactggatgcatcctactccttcattgtggttcccaggatgttggtggacttcctctctgagaagaaggtaatctcctatagaagctgcatcactcagctctttttcttgcattttcttggagcgggagagatgttcctcctcgttgtgatggcctttgaccgctacatcgccatctgccggcctttacactattcaaccatcatgaaccctagagcctgctatgcattatcgttggttctgtggcttgggggctttatccattccattgtacaagtagcccttatcctgcacttgcctttctgtggcccaaaccagctcgataacttcttctgtgatgttccacaggtcatcaagctggcctgcaccaatacctttgtggtggagcttctgatggtctccaacagtggcctgctcagcctcctgtgcttcctgggccttctggcctcctatgcagtcatcctctgtcgtataagggagcactcctctgaaggaaagagcaaggctatttccacatgcaccacccatattatcattatatttctcatgtttggacctgctattttcatctacacttgccccttccaggctttcccagctgacaaggtagtttctcttttccatactgtcatctttcctttgatgaaccctgttatttatacgcttcgcaaccaggaggtgaaagcttccatgaggaagttgttaagtcaacatatgttttgctga

SEQ ID NO: 162282 - DNA, 939 bp, Homo sapiens
  Payload ID: 11822
  Gene Symbol: OR4P4
  Gene Name: olfactory receptor, family 4, subfamily P, member 4
  Uniprot ID: Q8NGL7
  ENST ID: ENST00000314612
  CDS Start-End: 1-939
atggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctga

SEQ ID NO: 162283 - DNA, 944 bp, Homo sapiens
  Payload ID: 11823
  Gene Symbol: OR4Q2
  Gene Name: olfactory receptor, family 4, subfamily Q, member 2 (gene/pseudogene)
  ENST ID: ENST00000541415
  CDS Start-End: 1-944
atggataaaaaccaaacagaagtgatgagagaatttttcttgtcagggttctcacagacaccatctattgaagcagggctatttgtactatttcttttcttctatatgtccatttgggttggcaatgtcctcatcatggtcacagtagcatctgataaatacctgaattcatcacccatgtatttccttcttggcaacctctcatttctggacctatgttattcaacagtaacgacccctaagcttctggctgacttctttaatcatgaaaaactcatttcctatgaccaatgcattgtgcaactcttcttcctgcattttgtaggggcagctgagatgttcctgctcacagtgatggcgtacgatcgctatgttgcaatctgtcgcccgctgcactacaccactgtcatgagtcgggggttatgctgtgtgttggttgctgcctcctggatgggaggatttgtgcactccactgtccagaccattctcactgtccatctacccttttgtgggccaaatcaggtggaaaacttttttttgtgatgttccccctgtcatcaaacttgcttgtgctgacacttttgtcattgaattgctcatggtatctaacagtgggttgatctccaccatctcctttgtggtgctgatttcctcctacaccactatcctagtcaagattcgctccaaggaaggaaggcgaaaggcactctccacgtgtgcctctcacctcatggtggtaacactgttttttggaccctgtattttcatctacgctcgtcctttctctacattttctgtggacaagatggtgtctgtactctacaatgttattaccccaatgctaaaccccctcatctacacacttcggaacaaagaggtaaagtcagccatgcagaagctctgggtcagaaatgggcttacttggaaaaagcaggagacatgag

SEQ ID NO: 162284 - DNA, 921 bp, Homo sapiens
  Payload ID: 11823
  Gene Symbol: OR4Q2
  Gene Name: olfactory receptor, family 4, subfamily Q, member 2 (gene/pseudogene)
  ENST ID: ENST00000622436
  CDS Start-End: 1-921
atggataaaaaccaaacagaagtgatgagagaatttttcttgtcagggttctcacagacaccatctattgaagcagggctatttgtactatttcttttcttctatatgtccatttgggttggcaatgtcctcatcatggtcacagtagcatctgataaatacctgaattcatcacccatgtatttccttcttggcaacctctcatttctggacctatgttattcaacagtaacgacccctaagcttctggctgacttctttaatcatgaaaaactcatttcctatgaccaatgcattgtgcaactcttcttcctgcattttgtaggggcagctgagatgttcctgctcacagtgatggcgtacgatcgctatgttgcaatctgtcgcccgctgcactacaccactgtcatgagtcgggggttatgctgtgtgttggttgctgcctcctggatgggaggatttgtgcactccactgtccagaccattctcactgtccatctacccttttgtgggccaaatcaggtgacttttttttgtgatgttccccctgtcatcaaacttgcttgtgctgacacttttgtcattgaattgctcatggtatctaacagtgggttgatctccaccatctcctttgtggtgctgatttcctcctacaccactatcctagtcaagattcgctccaaggaaggaaggcgaaaggcactctccacgtgtgcctctcacctcatggtggtaacactgttttttggaccctgtattttcatctacgctcgtcctttctctacattttctgtggacaagatggtgtctgtactctacaatgttattaccccaatgctaaaccccctcatctacacacttcggaacaaagaggtaaagtcagccatgcagaagctctgggttaaaataataacttttcaa

SEQ ID NO: 162285 - DNA, 942 bp, Homo sapiens
  Payload ID: 11824
  Gene Symbol: OR4Q3
  Gene Name: olfactory receptor, family 4, subfamily Q, member 3
  Uniprot ID: Q8NH05
  ENST ID: ENST00000331723
  CDS Start-End: 1-942
atgaaaaaagaacaagattctaatgtgacagaatttgttcttctgggcctatcatcttcttgggagctgcagctatttctcttcttactatttttgtttttttacattgctattgtcctgggaaacctcttgatagtggtaacagtgcaagcccatgctcacctgctccaatctcctatgtattattttttaggtcatctctctttcattgacctatgcctgagctgtgttactgtgccaaagatgttaggggatttcctacagcagggcaagagcatctctttttcaggatgcctggcccagatctacttcctccactttctaggagccagtgagatgtttttgctgacagtcatggcctatgacaggtatgttgccatctgtaaccctttgcgctaccttacagtcatgaacccccagctatgcctttggttggttcttgcctgctggtgtgggggttttatccactctatcatgcaggtcatactagtcatccagctgcctttctgtgggcccaatgaactggacaacttctactgtgatgtcccacaagtcatcaagctggcctgcatggacacctatgtggtagaggtgctggtgatagccaacagtggtctgctgtctcttgtctgcttcttggtcttactattctcttatgctatcatcctgatcaccctgagaacacacttctgccagggccagaacaaggtcttctctacctgtgcttctcacctgacagtggtcagcctgatcttcgtgccatgcgtattcatctatttgaggcctttctgcagcttctctgtggataagatattctccttgttttacacagtgattacacctatgttgaaccccctcatctacacactcagaaatactgatatgaagacagctatgaagaagctgaggataaaaccatgtggcattccattgccttgttaa

SEQ ID NO: 162286 - DNA, 930 bp, Homo sapiens
  Payload ID: 11825
  Gene Symbol: OR4S1
  Gene Name: olfactory receptor, family 4, subfamily S, member 1
  Uniprot ID: Q8NGB4
  ENST ID: ENST00000319988
  CDS Start-End: 1-930
atgggtgccaagaacaatgtgactgagtttgttttatttggcctttttgagagcagagagatgcagcatacatgctttgtggtattcttcctctttcatgtgctcactgtcctggggaaccttctggtcatcatcaccatcaatgctagaaagaccctgaagtctcccatgtatttcttcctgagccagttgtcttttgctgacatatgttatccatccactaccatacccaagatgattgctgacacttttgtggagcataagatcatctccttcaatggctgcatgacccagctcttttctgcccacttctttggtggcactgagatcttcctccttacagccatggcctatgaccgctatgtggccatctgtaggcccctgcactacacagccatcatggattgccggaagtgtggcctgctagcgggggcctcctggttagctggcttcctgcattccatcctgcagaccctcctcacggttcagctgcctttttgtgggcccaatgagatagacaacttcttctgtgatgttcatcccctgctcaagttggcctgtgcagacacctacatggtaggtctcatcgtggtggccaacagcggtatgatttctttagcatccttttttatccttatcatttcctatgttatcatcttactgaacctaagaagccagtcatctgaggaccggcgtaaggctgtctccacatgtggctcacacgtaatcactgtccttttggttctcatgccccccatgttcatgtacattcgtccctccaccaccctggctgctgacaaacttatcatcctctttaacattgtgatgccacctttgctgaaccctttgatctatacactaaggaacaacgatgtgaaaaatgccatgaggaagctgtttagggtcaagaggagcttaggggagaagtga

SEQ ID NO: 162287 - DNA, 936 bp, Homo sapiens
  Payload ID: 11826
  Gene Symbol: OR4S2
  Gene Name: olfactory receptor, family 4, subfamily S, member 2
  Uniprot ID: Q8NH73
  ENST ID: ENST00000312422
  CDS Start-End: 1-936
atggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatag

SEQ ID NO: 162288 - DNA, 918 bp, Homo sapiens
  Payload ID: 11827
  Gene Symbol: OR4X1
  Gene Name: olfactory receptor, family 4, subfamily X, member 1 (gene/pseudogene)
  Uniprot ID: Q8NH49
  ENST ID: ENST00000320048
  CDS Start-End: 1-918
atggttgctacaaacaatgtgactgaaataattttcgtgggattttcccagaattggagtgagcagagggtcatttctgtgatgtttctcctcatgtacacagctgttgtgctgggcaatggcctcattgtggtgaccatcctggccagcaaagtgctcacctcccccatgtatttctttctcagctacttatcctttgtggagatctgctactgttctgtcatggcccccaagcttatctttgactcctttatcaagaggaaagtcatttctctcaagggctgcctcacacagatgttttccctccatttctttggtggcactgaggcctttctcctgatggtgatggcctatgaccgctatgtggccatctgcaagcccttgcactacatggccatcatgaaccagcgaatgtgtggtctcctcgtgaggatagcatggggcgggggcctgctgcattctgttgggcaaaccttcctgattttccagctcccgttctgtggccccaacatcatggaccactacttctgtgatgtccacccagtgctggagctggcctgcgcagacaccttcttcattagcctgctgatcatcaccaatggcggctccatctccgtagtcagtttcttcgtgctgatggcttcctacctgatcatcctgcacttcctgagaagccacaacttggaggggcagcacaaggccctctccacctgtgcctctcatgtcacagttgtcgacctgttcttcataccttgctccttggtctatattaggccctgtgtcaccctccctgcagacaagatagttgctgtattttatacagtggtcacacctctcttaaaccctgtgatttactccttcaggaatgctgaagtgaaaaatgccatgaggagatttattgggggaaaagtaatttga

SEQ ID NO: 162289 - DNA, 918 bp, Homo sapiens; identical to SEQ ID NO: 162288
  Payload ID: 11827
  Gene Symbol: OR4X1
  Gene Name: olfactory receptor, family 4, subfamily X, member 1 (gene/pseudogene)
  Uniprot ID: Q8NH49
  ENST ID: ENST00000624144
  CDS Start-End: 1-918

SEQ ID NO: 162290 - DNA, 918 bp, Homo sapiens; identical to SEQ ID NO: 162288
  Payload ID: 11827
  Gene Symbol: OR4X1
  Gene Name: olfactory receptor, family 4, subfamily X, member 1 (gene/pseudogene)
  Uniprot ID: Q8NH49
  ENST ID: ENST00000624797
  CDS Start-End: 1-918

SEQ ID NO: 162291 - DNA, 912 bp, Homo sapiens
  Payload ID: 11828
  Gene Symbol: OR4X2
  Gene Name: olfactory receptor, family 4, subfamily X, member 2 (gene/pseudogene)
  Uniprot ID: Q8NGF9
  ENST ID: ENST00000623137
  CDS Start-End: 1-912
atgactgaattcatttttctggtactttctcccaaccaggaggtgcagagggtttgctttgtgatatttctgttcttgtacacagcaattgtgctggggaatttcctcattgtgctcactgtcatgaccagcagaagccttggttcccccatgtacttcttcctcagctacctctccttcatggagatctgctactcctccgctacagcccccaaactcatctcagatctgctggctgaaaggaaagtcatatcttggtggggctgcatggcacagcttttcttcttgcacttctttggtggcactgagattttcctgctcactgtgatggcctatgaccactatgtggccatctgcaagcccctcagctacaccaccatcatgaactggcaggtgtgtactgtccttgtaggaatagcatgggtgggaggcttcatgcattcctttgcacaaatccttctcatcttccacctgctcttctgtggccccaatgtgatcaatcactatttctgtgacctagttccccttctcaaacttgcctgctctgacaccttcctcattggtctgctgattgttgccaatggaggcaccctgtctgtgatcagttttggggtcctcttagcatcctatatggtcatcttgctccatctgagaacctggagctctgaagggtggtgcaaagccctctccacctgtgggtcccatttcgctgtggttatcttgttctttgggccctgcgtcttcaactctctgaggccttctaccactctgcccatagacaagatggtggctgtgttctacacagtgataaccgcgatcctgaaccctgtcatctactctctgagaaatgctgaaatgaggaaggccatgaagaggctgtggattaggacattgagactaaatgagaaatag

SEQ ID NO: 162292 - DNA, 1051 bp, Homo sapiens
  Payload ID: 11829
  Gene Symbol: OR5A1
  Gene Name: olfactory receptor, family 5, subfamily A, member 1
  Uniprot ID: Q8NGJ0
  ENST ID: ENST00000302030
  CDS Start-End: 26-973
cttgtccttgtggtccacgggaagcatgtccataaccaaagcctggaacagctcatcagtgaccatgttcatcctcctgggattcacagaccatccagaactccaggccctcctctttgtgaccttcctgggcatctatcttaccaccctggcctggaacctggccctcatttttctgatcagaggtgacacccatctgcacacacccatgtacttcttcctaagcaacttatctttcattgacatctgctactcttctgctgtggctcccaatatgctcactgacttcttctgggagcagaagaccatatcatttgtgggctgtgctgctcagttttttttctttgtcggcatgggtctgtctgagtgcctcctcctgactgctatggcatacgaccgatatgcagccatctccagcccccttctctaccccactatcatgacccagggcctctgtacacgcatggtggttggggcatatgttggtggcttcctgagctccctgatccaggccagctccatatttaggcttcacttttgcggacccaacatcatcaaccacttcttctgcgacctcccaccagtcctggctctgtcttgctctgacaccttcctcagtcaagtggtgaatttcctcgtggtggtcactgtcggaggaacatcgttcctccaactccttatctcctatggttacatagtgtctgcggtcctgaagatcccttcagcagagggccgatggaaagcctgcaacacgtgtgcctcgcatctgatggtggtgactctgctgtttgggacagcccttttcgtgtacttgcgacccagctccagctacttgctaggcagggacaaggtggtgtctgttttctattcattggtgatccccatgctgaaccctctcatttacagtttgaggaacaaagagatcaaggatgccctgtggaaggtgttggaaaggaagaaagtgttttcttaggtcatgcgtagaaacttatttatccaaactgctggagaattaaacaatccaagccttcacctccacctctgcctcagg

SEQ ID NO: 162293 - DNA, 1034 bp, Homo sapiens
  Payload ID: 11830
  Gene Symbol: OR5A2
  Gene Name: olfactory receptor, family 5, subfamily A, member 2
  Uniprot ID: Q8NGI9
  ENST ID: ENST00000302040
  CDS Start-End: 24-998
gactttatgcaggaagcaggcctatggctgtaggaaggaacaacacaattgtgacaaaattcattctcctgggactttcagaccatcctcaaatgaagattttccttttcatgttatttctggggctctacctcctgacgttggcctggaacttaagcctcattgccctcattaagatggactctcacctgcacatgcccatgtacttcttcctcagtaacctgtccttcctggacatctgctatgtgtcctccaccgcccctaagatgctgtctgacatcatcacagagcagaaaaccatttcctttgttggctgtgccactcagtactttgtcttctgtgggatggggctgactgaatgctttctcctggcagctatggcctatgaccggtatgctgcaatctgcaaccccttgctttacacagtcctcatatcccatacactttgtttaaagatggtggttggcgcctatgtgggtggattccttagttctttcattgaaacatactctgtctatcagcatgatttctgtgggccctatatgatcaaccactttttctgtgacctccctccagtcctggctctgtcctgctctgataccttcaccagcgaggtggtgaccttcatagtcagtgttgtcgttggaatagtgtctgtgctagtggtcctcatctcttatggttacattgttgctgctgttgtgaagatcagctcagctacaggtaggacaaaggccttcagcacttgtgcctctcacctgactgctgtgaccctcttctatggttctggattcttcatgtacatgcgacccagttccagctactccctaaacagggacaaggtggtgtccatattctatgccttggtgatccccgtggtgaatcccatcatctacagttttaggaataaggagattaaaaatgccatgaggaaagccatggaaagggaccccgggatttctcacggtggaccattcatttttatgaccttgggctaatgtttacaatgaagctgtgagctaggtgaattgtgc

SEQ ID NO: 162294 - DNA, 925 bp, Homo sapiens
  Payload ID: 11831
  Gene Symbol: OR5AC1
  Gene Name: olfactory receptor, family 5, subfamily AC, member 1 (gene/pseudogene)
  ENST ID: ENST00000429239
  CDS Start-End: 1-925
atggcagaagaaaataagattctggtgactcactttgtcctcacaggactcacagatcatccagggctgcaggcgcccctgttcctggtgttcttggtcatctacctcatcaccctggtgggcaaccttggcctgatggctctcatctggaaggacccccaccttcacacccccatatacttatttcttggcagtttagcctttgcagatgcatgcacttcatcctctgtaacttctaagatgcttatcaatttttttatcaaagaatcatatgctatccatggctaagtgtgccacccagttttacttttttggttccaatgcaaccacagaatgcttcctgctggtagtgatggcctatgaccgctatgtagccatatgcaatcccttgctttatccagtggtgatgtccaatagcctctgtactcagtttataggtatttcatattttattggttttctgcattcagcgattcatgtgggtttgttatttagattaactttctgcaggtccaatattatacattatttctactgtgaaattttacagctgttcaaaatttcttgcaccaatcctacagttaatatacttctgattttcatcttttcagcatttatacaagtcttcacttttatgactcttatcgtctcttactcctatattctctctgccatcctgaaaaagaagtctgagaagggtagaagcaaagccttctctacttgcagtgcccatctgctctctgtctctttgttctacggcaccctcttcttcatgtatgtgagttctaggtctggatcagctgcagatcaggccaaaatgtattctttattttacacaataataattcctttactaaatccttttatttacagcctaaggaacaaagaggttatagatgccctgagaagaatcatgaagaaataa

SEQ ID NO: 162295 - DNA, 930 bp, Homo sapiens
  Payload ID: 11832
  Gene Symbol: OR5AC2
  Gene Name: olfactory receptor, family 5, subfamily AC, member 2
  Uniprot ID: Q9NZP5
  ENST ID: ENST00000358642
  CDS Start-End: 1-930
atggatatatcagagggaaataagactcttgtgacagagtttgttctcacaggacttacagatcgaccatggctgcacgtcctcttctttgttgtgtttttggtggtctatctcatcaccatggtgggcaaccttggactgatagttctaatttggaacgacccccatcttcatatgcccatgtacttattccttggtggtttagccttttcagatgcttgtacttcaacctctataacccctaggatgctggtcaatttcttagacaagactgcaatgatatccctagctgagtgcatcacccagttttacttttttgcttccagtgcaactacagaatgcttcctcctggtgatgatggcctatgaccgctatgtagccatatgtaatcccttgctttatccagtgatgatgtccaacaaactcagcgctcagttgctaagtatttcatatgtaattggtttcctgcatcctctggttcatgtgagtttactattgcgactaactttctgcaggtttaacataatacattatttctactgtgaaattttacaactgttcaaaatttcatgcaatggtccatctattaacgcactaatgatatttatttttggtgcttttatacaaatacccactttaatgactatcataatctcttatactcgtgtgctctttgatattctgaaaaaaaagtctgaaaagggcagaagcaaagccttctccacatgcggcgcccatctgctttctgtctcattgtactacggaactctgatcttcatgtatgtgcgtcctgcatctggcttagctgaagaccaagacaaagtgtattctctgttttacacgattataattcccctgctaaacccatttatttacagcttgagaaataaaaaagtcatgcatgcattgagaagagttataaggaagtaa

SEQ ID NO: 162296 - DNA, 996 bp, Homo sapiens
  Payload ID: 11833
  Gene Symbol: OR5AK2
  Gene Name: olfactory receptor, family 5, subfamily AK, member 2
  Uniprot ID: Q8NH90
  ENST ID: ENST00000326855
  CDS Start-End: 43-972
ttctgggtccttctcttggtcatttctagacttttactagccatgacactaggaaacagcactgaagtcactgaattctatcttctgggatttggtgcccagcatgagttttggtgtatcctcttcattgtattccttctcatctatgtgacctccataatgggtaatagtggaataatcttactcatcaacacagattccagatttcaaacactcacgtacttttttctacaacatttggcttttgttgatatctgttacacttctgctatcactcccaagatgctccaaagcttcacagaagaaaagaatttgatgttatttcagggctgtgtgatacaattcttagtttatgcaacatttgcaaccagtgactgttatctcctggctatgatggcagtggatccttatgttgccatctgtaagccccttcactatactgtaatcatgtcccgaacagtctgcatccgtttggtagctggttcatacatcatgggctcaataaatgcctctgtacaaacaggttttacatgttcactgtccttctgcaagtccaatagcatcaatcactttttctgtgatgttccccctattcttgctctttcatgctccaatgttgacatcaacatcatgctacttgttgtctttgtgggatctaacttgatattcactgggttggtcgtcatcttttcctacatctacatcatggccaccatcctgaaaatgtcttctagtgcaggaaggaaaaaatccttctcaacatgtgcttcccacctgaccgcagtcaccattttctatgggacactctcttacatgtatttgcagtctcattctaataattcccaggaaaatatgaaagtggcctttatattttatggcacagttattcccatgttaaatcctttaatctatagcttgagaaataaggaagtaaaagaagctttaaaagtgatagggaaaaagttattttaaatcagccccagttgttaacattca

SEQ ID NO: 162297 - DNA, 1037 bp, Homo sapiens
  Payload ID: 11834
  Gene Symbol: OR5AN1
  Gene Name: olfactory receptor, family 5, subfamily AN, member 1
  Uniprot ID: Q8NGI8
  ENST ID: ENST00000313940
  CDS Start-End: 48-983
gcaatccattctcttgtctcctttctgatattaggagcactgagccaatgactgggggaggaaatattacagaaatcacctatttcatcctgctgggattctcagattttcccaggatcataaaagtgctcttcactatattcctggtgatctacattacatctctggcctggaacctctccctcattgttttaataaggatggattcccacctccatacacccatgtatttcttcctcagtaacctgtccttcatagatgtctgctatatcagctccacagtccccaagatgctctccaacctcttacaggaacagcaaactatcacttttgttggttgtattattcagtactttatcttttcaacgatgggactgagtgagtcttgtctcatgacagccatggcttatgatcgttatgctgccatttgtaaccccctgctctattcatccatcatgtcacccaccctctgtgtttggatggtactgggagcctacatgactggcctcactgcttctttattccaaattggtgctttgcttcaactccacttctgtgggtctaatgtcatcagacatttcttctgtgacatgccccaactgttaatcttgtcctgtactgacactttctttgtacaggtcatgactgctatattaaccatgttctttgggatagcaagtgccctagttatcatgatatcctatggctatattggcatctccatcatgaagatcacttcagctaaaggcaggtccaaggcattcaacacctgtgcttctcatctaacagctgtttccctcttctatacatcaggaatctttgtctatttgagttccagctctggaggttcttcaagctttgacagatttgcatctgttttctacactgtggtcattcccatgttaaatcccttgatttacagtttgaggaacaaagaaattaaagatgccttaaagaggttgcaaaagagaaagtgctgctgagtttacagattctgagatttctgccagatatggcccatcagaatctccctaacc

SEQ ID NO: 162298 - DNA, 951 bp, Homo sapiens
  Payload ID: 11835
  Gene Symbol: OR5AP2
  Gene Name: olfactory receptor, family 5, subfamily AP, member 2
  Uniprot ID: Q8NGF4
  ENST ID: ENST00000302981
  CDS Start-End: 1-951
atgagacttatgaaagaggttcgaggcagaaatcaaacagaagtaacagaatttctcctcttaggactttccgacaatccagatctacaaggagtcctctttgcattgtttctgttgatctatatggcaaacatggtgggcaatttggggatgattgtattgattaagattgatctctgtctccacacccccatgtatttctttctcagtagcctctcttttgtagatgcctcttactcttcttccgtcactcccaagatgctggtgaacctcatggctgagaataaggccatttcttttcatggatgtgctgcccagttctacttctttggctccttcctggggactgagtgcttcctgttggccatgatggcatatgaccgctatgcagccatttggaaccccctgctctacccagttctcgtgtctgggagaatttgctttttgctaatagctacctccttcttagcaggttgtggaaatgcagccatacatacagggatgacttttaggttgtccttttgtggttctaataggatcaaccatttctactgtgacaccccgccactgctcaaactctcttgctctgatacccacttcaatggcattgtgatcatggcattctcaagttttattgtcatcagctgtgttatgattgtcctcatttcctacctgtgtatcttcattgccgtcttgaagatgccttcgttagagggcaggcacaaagccttctccacctgtgcctcttacctcatggctgtcaccatattctttggaacaatcctcttcatgtacttgcgccctacatctagctactcaatggagcaagacaaggttgtctctgtcttttatacagtaataatccctgtgctaaatcccctcatctatagtttaaaaaataaggatgtaaaaaaggccctaaagaagatcttatggaaacacatcttgtag

SEQ ID NO: 162299 - DNA, 1006 bp, Homo sapiens
  Payload ID: 11835
  Gene Symbol: OR5AP2
  Gene Name: olfactory receptor, family 5, subfamily AP, member 2
  ENST ID: ENST00000544374
  CDS Start-End: 30-983
tgtgcatcttctttcttattgcagctcaaatgatgagacttatgaaagaggttcgaggcagaaatcaaacagaagtaacagaatttctcctcttaggactttccgacaatccagatctacaaggagtcctctttgcattgtttctgttgatctatatggcaaacatggtgggcaatttggggatgattgtattgattaagattgatctctgtctccacacccccatgtatttctttctcagtagcctctcttttgtagatgcctcttactcttcttccgtcactcccaagatgctggtgaacctcatggctgagaataaggccatttcttttcatggatgtgctgcccagttctacttctttggctccttcctggggactgagtgcttcctgttggccatgatggcatatgaccgctatgcagccatttggaaccccctgctctacccagttctcgtgtctgggagaatttgctttttgctaatagctacctccttcttagcaggttgtggaaatgcagccatacatacagggatgacttttaggttgtccttttgtggttctaataggatcaaccatttctactgtgacaccccgccactgctcaaactctcttgctctgatacccacttcaatggcattgtgatcatggcattctcaagttttattgtcatcagctgtgttatgattgtcctcatttcctacctgtgtatcttcattgccgtcttgaagatgccttcgttagagggcaggcacaaagccttctccacctgtgcctcttacctcatggctgtcaccatattctttggaacaatcctcttcatgtacttgcgccctacatctagctactcaatggagcaagacaaggttgtctctgtcttttatacagtaataatccctgtgctaaatcccctcatctatagtttaaaaaataaggatgtaaaaaaggccctaaagaagatcttatggaaacacatcttgtagagccatgttacccatcatttgtt

SEQ ID NO: 162300 - DNA, 933 bp, Homo sapiens
  Payload ID: 11836
  Gene Symbol: OR5AR1
  Gene Name: olfactory receptor, family 5, subfamily AR, member 1 (gene/pseudogene)
  Uniprot ID: Q8NGP9
  ENST ID: ENST00000625024
  CDS Start-End: 1-933
atggataaagaaaacagctcaatggtgactgagtttatcttcatgggcatcacccaggaccctcagatggagatcatcttcttcgtggtcttcctcatagtttacctggttaatgtagtggggaatattggtatgattatcctgattacaacagacactcagcttcacacacccatgtattttttcctctgcaacctctcctttgttgacctgggctactcctcagccattgcccccaggatgctggctgacttcctaacaaatcacaaagttatctccttctccagctgtgccacccagtttgctttttttgtaggttttgtggatgctgagtgctatgtcctggcagccatggcctatggtcgttttgtggccatttgtcgacccctccactatagcaccttcatgtccaagcaggtctgcttggctctcatgctgggctcttacctggctggtctagtgagtttagtagcccacactaccctcaccttcagcctgagttactgtggttccaatatcatcaatcatttcttctgcgaaatcccaccactcttggccctctcttgctcagacacctacatcagtgagatcttgctcttcagtctgtgtggcttcattgaattcagcaccatcctcatcatcttcatctcctatacctttatccttgttgcaatcatcagaatgcgttcagctgaaggccgccttaaggctttctccacctgcgggtctcaccttactggcatcaccctcttctatggcacagtcatgtttatgtacctgaggccaacatccagctactccctggaccaagacaagtgggcctctgtgttctacacggttatcatccccatgttaaatcccttgatctacagtttgcggaacaaggatgtgaaagctgctttcaaaaagctaattggaaaaaaatctcaataa

SEQ ID NO: 162301 - DNA, 975 bp, Homo sapiens
  Payload ID: 11837
  Gene Symbol: OR5AS1
  Gene Name: olfactory receptor, family 5, subfamily AS, member 1
  Uniprot ID: Q8N127
  ENST ID: ENST00000313555
  CDS Start-End: 1-975
atgttggagagtaattacaccatgccaactgagttcctatttgttggattcacagattatctacctctcagagtcacactgttcttggtattccttctggtatatacattaactatggtcggaaatatactcttaataattctagttaatattaattcaagccttcaaattcccatgtattattttcttagcaacttatctttcttagacatcagctgttctacagcaatcactcctaaaatgctggcaaacttcttggcatccaggaaaagcatctctccttatgggtgtgcactacaaatgtttttcttcgcttcttttgctgatgctgagtgccttatcctggcagcaatggcttatgaccgctatgcagccatctgcaacccactgctctatactacactgatgtctaggagagtctgtgtctgcttcattgtgttggcatatttcagtggaagtacaacatcactggtccatgtgtgcctcacattcaggctgtcattttgtggctccaatatcgtcaatcattttttctgtgatatcccacctcttctggctttatcatgtacagacactcagatcaaccagcttctgctctttgctttgtgcagcttcatccagaccagcacttttgtggtaatatttatttcttacttctgcatcctcatcactgtgttgagcatcaagtcctcaggtggcagaagcaaaacattctccacttgtgcttcccacctcatagcagtcaccttattctatggagcgctcctgtttatgtacttacagcccaccactagctattccctagacactgataaggtggtggcagtgttttatactgttgtatttcccatgtttaatccaataatttatagtttcagaaacaaggatgtgaaaaatgctctcaaaaagctattagaaagaattggatattcaaatgaatggtatttaaatcgtttaagaatagtcaatatctaa

SEQ ID NO: 162302 - DNA, 1199 bp, Homo sapiens
  Payload ID: 11838
  Gene Symbol: OR5AU1
  Gene Name: olfactory receptor, family 5, subfamily AU, member 1
  Uniprot ID: Q8NGC0
  ENST ID: ENST00000304418
  CDS Start-End: 39-1127
ccaactaaccaaccaaccaaggagaaaagatcctctctatgacagagtttcatctgcaaagccaaatgccctcaataagactcatcttcagaaggctgtccttaggcagaattaaacccagtcagagccccaggtgttcaacctcatttatggtggtgccttctttctccatcgcagagcactggagaaggatgaaaggggcaaacctgagccaagggatggagtttgagctcttgggcctcaccactgacccccagctccagaggctgctcttcgtggtgttcctgggcatgtacacagccactctgctggggaacctggtcatgttcctcctgatccatgtgagtgccaccctgcacacacccatgtactccctcctgaagagcctctccttcttggatttctgctactcctccacggttgtgccccagaccctggtgaacttcttggccaagaggaaagtgatctcttattttggctgcatgactcagatgttcttctatgcgggttttgccaccagtgagtgctatctcatcgctgccatggcctatgaccgctatgccgctatttgtaaccccctgctctactcaaccatcatgtctcctgaggtctgtgcctcgctgattgtgggctcctacagtgcaggattcctcaattctcttatccacactggctgtatctttagtctgaaattctgcggtgctcatgtcgtcactcacttcttctgtgatgggccacccatcctgtccttgtcttgtgtagacacctcactgtgtgagatcctgctcttcatttttgctggtttcaaccttttgagctgcaccctcaccatcttgatctcctacttcttaattctcaacaccatcctgaaaatgagctcggcccagggcaggtttaaggcattttccacctgtgcatcccacctcactgccatctgcctcttctttggcacaacactttttatgtacctgcgccccaggtccagctactccttgacccaggaccgcacagttgctgtcatctacacagtggtgatcccagtgctgaaccccctcatgtactctttgagaaacaaggatgtgaagaaagctttaataaaggtttggggtaggaaaacaatggaatgatttctcaatgcattaccacatatctttagaaagtcaagggaacttttaccttaggtggtgtcaccctgagca

SEQ ID NO: 162303 - DNA, 1054 bp, Homo sapiens
  Payload ID: 11839
  Gene Symbol: OR5B12
  Gene Name: olfactory receptor, family 5, subfamily B, member 12
  Uniprot ID: Q96R08
  ENST ID: ENST00000302572
  CDS Start-End: 23-967
cagggcagctacataattcccaatggagaacaacacagaggtgactgaattcatccttgtggggttaactgatgacccagaactgcagatcccactcttcatagtcttccttttcatctacctcatcactctggttgggaacctggggatgattgaattgattctactggactcctgtctccacacccccatgtacttcttcctcagtaacctctccctggtggactttggttattcctcagctgtcactcccaaggtgatggtggggtttctcacaggagacaaattcatattatataatgcttgtgccacacaattcttcttctttgtagcctttatcactgcagaaagtttcctcctggcatcaatggcctatgaccgctatgcagcattgtgtaaacccctgcattacaccaccaccatgacaacaaatgtatgtgcttgcctggccataggctcctacatctgtggtttcctgaatgcatccattcatactgggaacactttcaggctctccttctgtagatccaatgtagttgaacactttttctgtgatgctcctcctctcttgactctctcatgttcagacaactacatcagtgagatggttattttttttgtggtgggattcaatgacctcttttctatcctggtaatcttgatctcctacttatttatatttatcaccatcatgaagatgcgctcacctgaaggacgccagaaggccttttctacttgtgcttcccaccttactgcagtttccatcttttatgggacaggaatctttatgtacttacgacctaactccagccatttcatgggcacagacaaaatggcatctgtgttctatgccatagtcattcccatgttgaatccactggtctacagcctgaggaacaaagaggttaagagtgcctttaaaaagactgtagggaaggcaaaggcctctataggattcatattttaattataaagaattcacaataagataattttttccacctcatattaatctttgtctaccaagcccaatatttgggcttcctcatggaca

SEQ ID NO: 162304 - DNA, 946 bp, Homo sapiens
  Payload ID: 11840
  Gene Symbol: OR5B17
  Gene Name: olfactory receptor, family 5, subfamily B, member 17
  Uniprot ID: Q8NGF7
  ENST ID: ENST00000357377
  CDS Start-End: 1-945
atggagaataatacagaggtgagtgaattcatcctgcttggtctaaccaatgccccagaactacaggttcccctctttatcatgtttaccctcatctacctcatcactctgactgggaacctggggatgatcatattaatcctgctggactctcatctccacactcccatgtacttttttctcagtaacctgtctcttgcaggcattggttactcctcagctgtcactccaaaggttttaactgggttgcttatagaagacaaagccatctcctacagtgcctgtgctgctcagatgttcttttgtgcagtctttgccactgtggaaaattacctcttgtcctcaatggcctatgaccgctacgcagcagtgtgtaaccccctacattataccaccaccatgacaacacgtgtgtgtgcttgtctggctataggctgttatgtcattggttttctgaatgcttctatccaaattggagatacatttcgcctctctttctgcatgtccaatgtgattcatcactttttctgtgacaaaccagcagtcattactctgacctgctctgagaaacacattagtgagttgattcttgttcttatatcaagttttaatgtcttttttgcacttcttgttaccttgatttcctatctgttcatattgatcaccattcttaagaggcacacaggtaagggataccagaagcctttatctacctgtggttctcacctcattgccattttcttattttatataactgtcatcatcatgtacatacgaccaagttccagtcattccatggacacagacaaaattgcatctgtgttctacactatgatcatccccatgctcagtcctatagtctataccctgaggaacaaagacgtgaagaatgcattcatgaaggttgttgagaaggcaaaatattctctagattcagtcttttaat

SEQ ID NO: 162305 - DNA, 1049 bp, Homo sapiens
  Payload ID: 11841
  Gene Symbol: OR5B2
  Gene Name: olfactory receptor, family 5, subfamily B, member 2
  Uniprot ID: Q96R09
  ENST ID: ENST00000302581
  CDS Start-End: 53-982
ttgctttatttctcattgctacaggtcatcttaagtttctcagataatactgatggagaattgtacggaagtgacaaagttcattcttctaggactaaccagtgtcccagaactacagatccccctctttatcttgttcaccttcatctacctcctcactctgtgtgggaacctggggatgatgttgctgatcctgatggactcttgtctccacacccccatgtactttttcctcagtaacctgtctctggtggactttggatactcctcagctgtcactcccaaggtcatggctgggttccttagaggagacaaggtcatctcctacaatgcatgtgctgttcagatgttcttctttgtagccttggccacggtggaaaattacttgttggcctcaatggcctatgaccgctatgcagcagtgtgcaaacccctacactacaccaccaccatgacggccagtgtaggtgcctgtctggccctaggctcatatgtctgtggcttcctaaatgcctcattccacattgggggcatattcagtctctctttctgtaaatccaatctggtacatcactttttctgtgatgttccagcagtcatggctctgtcttgctctgataaacacactagtgaggtgattctggtttttatgtcaagctttaatatcttttttgttcttctagttatctttatctcctacttgttcatattcatcaccatcttgaagatgcattcagctaagggacaccaaaaagcattgtccacctgtgcctctcacttcactgcagtctccgtcttctatgggacagtaatcttcatctacttgcagcccagctccagccactccatggacacagacaaaatggcatctgtgttctatgctatgatcatccccatgctgaaccctgtggtctacagcctgaggaacagagaagtccagaatgcattcaagaaagtgttgagaaggcaaaaatttctataagtttggaattttaacattgttgtatacacaaaaatgttgtttccctcatctcagactttcctcatgc

SEQ ID NO: 162306 - DNA, 931 bp, Homo sapiens
  Payload ID: 11842
  Gene Symbol: OR5B21
  Gene Name: olfactory receptor, family 5, subfamily B, member 21
  Uniprot ID: A6NL26
  ENST ID: ENST00000360374
  CDS Start-End: 1-930
atggagaatagcacagaagtgacagagtttatcctcttgggattaacagatgaccccaatcttcagatacccctcctcctggcatttttattcatctacctcatcaccctgcttgggaatgggggaatgatggtgatcatccactcagactcccatctccacactccaatgtactttttcctcagtaacctctcccttgtagacttgggttactcatcagctgtagcccccaaaacggtggctgcattgcggtcaggggacaaggccatctcctacgatggatgtgcagctcagttcttcttctttgtggggtttgccactgttgagtgctacctcctggcctccatggcctatgatcgccatgcagcggtatgtaggcctcttcattacaccaccaccatgacagcaggtgtgtgtgccctccttgctactggttcctatgtctctggcttcctcaatgcctctatccatgcagcaggcaccttcagactctccttctgtggttctaatgagattaatcatttcttctgtgacattcccccactcctggctctctcatgctctgacacacgcatcagcaagttggtggtctttgtggcaggcttcaacgtctttttcaccctcctggtcatccttatttcttacttcttcatatgcatcaccattcagaggatgcattctgctgaagggcagaagaaagtcttctccacctgtgcttcccatctcactgctttgtccatcttctatggcacaatcatcttcatgtacttacagcccaactccagccagtccgtggacacagacaaaatagcctctgtgttttacacagtggtgattcccatgctgaatcccttgatatacagccttaggaacaaagaagtgaaaagtgctctctggaaaatactcaacaaactttacccccaatattaaa

SEQ ID NO: 162307 - DNA, 946 bp, Homo sapiens
  Payload ID: 11843
  Gene Symbol: OR5B3
  Gene Name: olfactory receptor, family 5, subfamily B, member 3
  Uniprot ID: Q8NH48
  ENST ID: ENST00000309403
  CDS Start-End: 1-945
atggaaaataagacagaagtaacacaattcattcttctaggactaaccaatgactcagaactgcaggttcccctctttataacgttccccttcatctatattatcactctggttggaaacctgggaattattgtattgatattctgggattcctgtctccacaatcccatgtacttttttctcagtaacttgtctctagtggacttttgctactcttcagctgtcactcccatcgtcatggctggattccttatagaagacaaggtcatctcttacaatgcatgtgctgctcaaatgtatatctttgtagcttttgccactgtggaaaattacctcttggcctcaatggcctatgaccgctatgcagcagtgtgcaaacccctacattacaccacaaccatgacaacaactgtgtgtgctcgtctggccataggctcctacctctgtggtttcctgaatgcctccatccacactggggacacatttagtctctctttctgtaagtccaatgaagtccatcactttttctgtgatattccagcagtcatggttctctcttgctctgatagacatattagcgagcttgttcttatttatgttgtgagcttcaatatctttatagctctcctggttatcttgatatcctacacattcatttttatcaccatcctaaagatgcactcagcttcagtataccagaagcctttgtccacctgtgcctctcatttcattgcagtcggcatcttctatgggactattatcttcatgtacttacaacccagctccagtcactccatggacacagacaaaatggcacctgtgttctatacaatggtcatccccatgctgaaccctctggtctatagtctgaggaacaaggaagtgaagagtgcattcaagaaagttgttgagaaggcaaaattgtctgtaggatggtcagtttaac

SEQ ID NO: 162308 - DNA, 963 bp, Homo sapiens
  Payload ID: 11844
  Gene Symbol: OR5C1
  Gene Name: olfactory receptor, family 5, subfamily C, member 1
  Uniprot ID: Q8NGR4
  ENST ID: ENST00000373680
  CDS Start-End: 1-963
atgaactcagagaacctcacccgggccgcggttgcccctgctgaattcgtcctcctgggcatcacaaatcgctgggacctgcgtgtggccctcttcctgacctgcctgcctgtctacctggtgagcctgctgggaaacatgggcatggcgctgctgatccgcatggatgcccggctccacacacctatgtacttcttcctggccaacctctccctgctggatgcctgctattcctccgccatcggccccaagatgctagtggacctgctgctgccccgagccaccatcccttacacagcctgtgccctccagatgtttgtctttgcaggtctggctgatactgagtgttgcttgctggcagccatggcctatgaccgctacgtggccatcagaaacccacttctctatacaacagctatgtcgcagcgtctatgcctggccttgctgggagcatcaggcctgggtggggcagtgagtgcctttgttcacacaaccctcaccttccgcctgagcttctgccgctcccggaagatcaatagcttcttctgcgatatccctccactgctggccatctcgtgcagtgacaccagtctcaatgaactccttctcttcgccatctgtggcttcatccagacagccacggtgttagctatcacggtgtcttatggcttcatcgctggggctgtgatccacatgcgctcggtcgagggcagtcggcgagcagcctccaccggtggttcccacctcacagccgtggccatgatgtacgggacactcattttcatgtacctgcgccccagctccagctatgccctggacactgacaagatggcctctgtgttctataccctggtcatcccgtctctcaacccactcatctacagcctccgcaataaggaggtcaaggaggccctcaggcagacctggagccgattccactgtccagggcaggggtcccagtga

SEQ ID NO: 162309 - DNA, 945 bp, Homo sapiens
  Payload ID: 11845
  Gene Symbol: OR5D13
  Gene Name: olfactory receptor, family 5, subfamily D, member 13 (gene/pseudogene)
  Uniprot ID: Q8NGL4
  ENST ID: ENST00000361760
  CDS Start-End: 1-945
atgatggcatctgaaagaaatcaaagcagcacacccacttttattctcttgggtttttcagaatacccagaaatccaggttccactctttctggttttcttgttcgtctacacagtcactgtagtggggaacttgggcatgataataatcatcagactcaattcaaaactccatacaatcatgtgctttttccttagtcacttgtccttgacagacttctgtttttccactgtagttacacctaaactgttggagaacttggttgtggaatacagaaccatctctttctctggttgcatcatgcaattttgttttgcttgcatttttggagtgacagaaactttcatgttagcagcgatggcttatgaccgttttgtggcagtttgtaaacccttgctgtataccactattatgtctcagaagctctgtgctcttctggtggctgggtcctatacatgggggatagtgtgctccctgatactcacatattttcttcttgacttatcgttttgtgaatctaccttcataaataattttatctgtgaccactctgtaattgtttctgcctcctactcagacccctatatcagccagaggctatgctttattattgccatattcaatgaggtgagcagcctaattatcattctgacatcatatatgcttattttcactaccattatgaagatgcgatctgcaagtgggcgccagaaaactttctccacctgtgcctcccacctgacagccatcactatcttccatggaactatccttttcctttactgtgttcctaatcctaaaacttctagcctcatagttacagtggcttctgtgttttacacagtggcgattccaatgctgaacccattgatctacagccttaggaacaaagatatcaataacatgtttgaaaaattagttgtcaccaaattgatttaccactga

SEQ ID NO: 162310 - DNA, 945 bp, Homo sapiens
  Payload ID: 11846
  Gene Symbol: OR5D14
  Gene Name: olfactory receptor, family 5, subfamily D, member 14
  Uniprot ID: Q8NGL3
  ENST ID: ENST00000335605
  CDS Start-End: 1-945
atgatgatggttttaaggaatctgagcatggagcccacctttgcccttttaggtttcacagattacccaaagcttcagattcctctcttccttgtgtttctgctcatgtatgttatcacagtggtaggaaaccttgggatgatcataataatcaagattaaccccaaatttcacactcctatgtactttttccttagtcacctctcttttgttgatttttgttactcttccattgtcactcccaagctgcttgagaacttggtaatggcagataaaagcatcttctactttagctgcatgatgcagtacttcctgtcctgcactgctgtggtgacagagtctttcttgctggcagtgatggcctatgaccgctttgtggccatctgcaatcctctgctttatacagtggccatgtcacagaggctctgtgccctgctggtggctgggtcatatctctggggcatgtttggccccttggtactcctttgttatgctctccggttaaacttctctggacctaatgtaatcaaccacttcttttgtgagtatactgctctcatctctgtgtctggctctgatatactcatcccccacctgctgcttttcagcttcgccaccttcaatgagatgtgtacactactgatcatcctcacttcctatgttttcatttttgtgactgtactaaaaatccgttctgttagtgggcgccacaaagccttctccacctgggcctcccacctgacttctatcaccatcttccatgggaccatccttttcctttactgtgtacccaactccaaaaactctcggcaaacagtcaaagtggcctctgtattttacacagttgtcaaccccatgctgaaccctctgatctacagcctaaggaataaagacgtgaaggatgctttctggaagttaatacatacacaagttccatttcactga

SEQ ID NO: 162311 - DNA, 987 bp, Homo sapiens
  Payload ID: 11847
  Gene Symbol: OR5D16
  Gene Name: olfactory receptor, family 5, subfamily D, member 16
  Uniprot ID: Q8NGK9
  ENST ID: ENST00000378396
  CDS Start-End: 1-987
atgtttctgacagagagaaatacgacatctgaggccacattcactctcttgggcttctcagattacctggaactgcaaattcccctcttctttgtatttctggcagtctacggcttcagtgtggtagggaatcttgggatgatagtgatcatcaaaattaacccaaaattgcatacccccatgtattttttcctcaaccacctctcctttgtggatttctgctattcctccatcattgctcccatgatgctggtgaacctggttgtagaagatagaaccatttcattctcaggatgtttggtgcaattctttttcttttgcacctttgtagtgactgaattaattctatttgcggtgatggcctatgaccactttgtggccatttgcaatcctctgctctacacagttgccatctcccagaaactctgtgccatgctggtggttgtattgtatgcatggggagtcgcatgttccctgacactcgcgtgctctgctttaaagttatcttttcatggtttcaacacaatcaatcatttcttctgtgagttatcctccctgatatcactctcttaccctgactcttatctcagccagttgcttcttttcactgttgccacttttaatgagataagcacactactcatcattctgacatcttatgcattcatcattgtcaccaccttgaagatgccttcagccagtgggcaccgcaaagtcttctccacctgtgcctcccacctgactgccatcaccatcttccatggcaccatcctcttcctctactgtgtacccaactccaaaaactccaggcacacagtcaaagtggcctctgtgttttacaccgtggtgatccccttgttgaatcccctgatctacagtctgagaaataaagatgttaaggatgcaatccgaaaaataatcaatacaaaatattttcatattaaacataggcattggtatccatttaattttgttattgaacaataa

SEQ ID NO: 162312 - DNA, 942 bp, Homo sapiens
  Payload ID: 11848
  Gene Symbol: OR5D18
  Gene Name: olfactory receptor, family 5, subfamily D, member 18
  Uniprot ID: Q8NGL1
  ENST ID: ENST00000333976
  CDS Start-End: 1-942
atgctgctgactgatagaaatacaagtgggaccacgttcaccctcttgggcttctcagattacccagaactgcaagtcccactcttcctggtttttctggccatctacaatgtcactgtgctagggaatattgggttgattgtgatcatcaaaatcaaccccaaactgcatacccccatgtactttttcctcagccaactctcctttgtggatttctgctattcctccatcattgctcccaagatgttggtgaaccttgttgtcaaagacagaaccatttcatttttaggatgcgtagtacaattctttttcttctgtacctttgtggtcactgaatcctttttattagctgtgatggcctatgaccgcttcgtggccatttgcaaccctctgctctacacagttaacatgtcccagaaactctgcgtgctgctggttgtgggatcctatgcctggggagtctcatgttccttggaactgacgtgctctgctttaaagttatgttttcatggtttcaacacaatcaatcacttcttctgtgagttctcctcactactctccctttcttgctctgatacttacatcaaccagtggctgctattctttcttgccacctttaatgaaatcagcacactactcatcgttctcacatcttatgcgttcattgttgtaaccatcctcaagatgcgttcagtcagtgggcgccgcaaagccttctccacctgtgcctcccacctgactgccatcaccatcttccatggcaccatcctcttcctttactgtgtgcccaactccaaaaactccaggcacacagtcaaagtggcctctgtgttttacaccgtggtgatccccatgttgaatcccctgatctacagtctgagaaataaagatgtcaaggatacagtcaccgagatactggacaccaaagtcttctcttactga

SEQ ID NO: 162313 - DNA, 945 bp, Homo sapiens
  Payload ID: 11849
  Gene Symbol: OR5F1
  Gene Name: olfactory receptor, family 5, subfamily F, member 1
  Uniprot ID: O95221
  ENST ID: ENST00000278409
  CDS Start-End: 1-945
atgaccagaaaaaattatacctcactgactgagttcgtcctattgggattagcagacacgctggagctacagattatcctctttttgttttttcttgtgatttatacacttacagtactgggaaatctcgggatgatcctcttaatcaggatcgattcccagcttcacacacccatgtatttcttcctggctaacctgtcctttgtggacgtttgtaactcaactaccatcaccccaaagatgctggcagatttattatcagagaagaaaaccatctcttttgctggctgcttcctacagatgtacttctttatctccctggcgacaaccgaatgcatcctctttgggttaatggcctatgacaggtatgcggccatatgtcgcccgctgctttactccttgatcatgtccaggaccgtctacctaaaaatggcagccggggcttttgctgcagggttgctgaacttcatggtcaacacaagccatgtcagcagcttgtcattctgtgactccaatgtcatccatcacttcttctgtgacagtcccccacttttcaagctctcttgttctgacacaatcctgaaagaaagcataagttctattttggctggtgtgaatattgtggggactctgcttgtcatcctctcctcctactcctacgttctcttctccattttttctatgcattcgggggaggggaggcacagagctttctccacgtgtgcctctcacctgacagccataattctgttctatgccacctgcatctatacttacctgagacctagttccagctactccctgaatcaggacaaagtggcttctgtgttctacacagtggtgattcccatgttgaatcctctgatctacagcctcaggagtaaggaagtaaagaaggctttagcgaatgtaattagcaggaaaaggacctcttcctttctgtga

SEQ ID NO: 162314 - DNA, 929 bp, Homo sapiens
  Payload ID: 11850
  Gene Symbol: OR5G3
  Gene Name: olfactory receptor, family 5, subfamily G, member 3 (gene/pseudogene)
  ENST ID: ENST00000435756
  CDS Start-End: 1-929
aaccagacagtagtgactgaatttctcttattgggcctcacagatcatccctatcagaagattgttctcttcttcatgtttctctttgtttatcttatcaccctgggaggtaacttggggatgatcactctcatatggattgatcccagactccacactcctatgtacttttttcttaggcacttgtcctttgtagatatttgttcctcttcttctgttgtgcctaagatgctgtgtaatatctttgcagagaaaaaagacatcacttttctgggttgtgctgcacagatgtggttctttggtctctttgaggcagctgagtgttttctctggctgccatggcatatgaccggtatgtggccatctgcaagcccttgttgtatacgctcattatgtctcagcaggtctgtatgcagctggtggtagggccttatgccatggctcttataagcaccatgactcatacaattttcactttttgcttacccttttgtggttcaaatattatcaatcactttttctgtgatatttttccactgctttccctagcatgtgcagacacctgggtgaataaatttgtgctgtttgtcttggctggagctataggagtactcagtggtctgatcatcatggtctcctatatttgcatcctgatgaccatcttgaagatccagactgctgatgggaagcaaaaagctttcttcacctgtttttctcaccttgcggctgtctccatcctgtatgggactcttttcttgatttatgttcggccaagttcaagttcctccctgggtatctataaagtgatttctctattttatactgtggtaatccccatggttaacccccttatttacagcttgaggaataaggaggtgaaagatgcattcagaagaaaaattgagaggaaaaaatttattataggtagg

SEQ ID NO: 162315 - DNA, 936 bp, Homo sapiens
  Payload ID: 11850
  Gene Symbol: OR5G3
  Gene Name: olfactory receptor, family 5, subfamily G, member 3 (gene/pseudogene)
  ENST ID: ENST00000631283
  CDS Start-End: 1-936
atggaagataagaaccagacagtagtgactgaatttctcttattgggcctcacagatcatccctatcagaagattgttctcttcttcatgtttctctttgtttatcttatcaccctgggaggtaacttggggatgatcactctcatatggattgatcccagactccacactcctatgtacttttttcttaggcacttgtcctttgtagatatttgttcctcttcttctgttgtgcctaagatgctgtgtaatatctttgcagagaaaaaagacatcacttttctgggttgtgctgcacagatgtggttctttggtctctttgaggcagctgagtgttttctctggctgccatggcatatgaccggtatgtggccatctgcaagcccttgttgtatacgctcattatgtctcagcaggtctgtatgcagctggtggtagggccttatgccatggctcttataagcaccatgactcatacaattttcactttttgcttacccttttgtggttcaaatattatcaatcactttttctgtgatatttttccactgctttccctagcatgtgcagacacctgggtgaataaatttgtgctgtttgtcttggctggagctataggagtactcagtggtctgatcatcatggtctcctatatttgcatcctgatgaccatcttgaagatccagactgctgatgggaagcaaaaagctttcttcacctgtttttctcaccttgcggctgtctccatcctgtatgggactcttttcttgatttatgttcggccaagttcaagttcctccctgggtatctataaagtgatttctctattttatactgtggtaatccccatggttaacccccttatttacagcttgaggaataaggaggtgaaagatgcattcagaagaaaaattgagaggaaaaaatttattatag

SEQ ID NO: 162316 - DNA, 942 bp, Homo sapiens
  Payload ID: 11851
  Gene Symbol: OR5H1
  Gene Name: olfactory receptor, family 5, subfamily H, member 1
  Uniprot ID: A6NKK0
  ENST ID: ENST00000354565
  CDS Start-End: 1-942
atggaagaggaaaatgcaacattgctgacagagtttgttctcacaggatttttatatcaaccacagtggaaaatacccctgttcctggcattcttggtaatatatctcatcaccatcatggggaatcttggtctgattgctgtcatctggaaagaccctcaccttcatatcccaatgtacttactccttgggaatttagcttttgtggatgcttggatatcatccacagtgaccccaaagatgctgaataacttcttagctaagagtaagatgatatctctctctgaatgcaagatacagtttttttcgtttgcaatcagtgtaaccacggaatgttttctcttggcaacgatggcatatgatcgctatgtagccatatgcaaacctttactttatccagccattatgaccaatggactgtgcatccggctattaatcttgtcatatgtaggtggtattcttcatgctttaatccatgaaggatttttattcagactaaccttctgtaactccaacatagtacatcacatttactgtgacactatcccattgtctaagatttcttgtactgattcttctattaattttctaatggtttttattttctcaggttcaattcaggtattcagcattgtgactattcttgtatcttatacatttgttctcttcgcaatcttaaaaaagaaatctgataaaggtgtaaggaaagccttttccacctgtggagcccatctcttctctgtctctttatactatggaccccttctcttcatttatgtgggccctgcatctccgcaagcagatgatcaagatatggtggagcctctattctacactgtcatcattcctttgttaaatcctatcatctacagtctgagaaataagcaagtcacagtttcattcacaaaaatgttaaaaaaacatgttaaggtttcatactaa

SEQ ID NO: 162317 - DNA, 1080 bp, Homo sapiens
  Payload ID: 11852
  Gene Symbol: OR5H14
  Gene Name: olfactory receptor, family 5, subfamily H, member 14
  Uniprot ID: A6NHG9
  ENST ID: ENST00000437310
  CDS Start-End: 61-993
tcattgcagatgttccctttcatttgttgcattttattttagaggacatgcagtgaggacatggaagaggaaaatgcaacattgctgacagagtttgttctcacaggatttttatatcaaccacagtggaaaatacccctgttcctggcattcttggtaatatatctcatcaccatcatggggaatcttggtctgattgctgtcatctggaaagaccctcatcttcatatcccaatgtacttactccttgggaatttagcttttgtggatgctttgttatcatcctcagtgactctgaagatgctgatcaacttcttagctaagagtaagatgatatctctctctgaatgcaagatacagttgttttcgtttgcaatcagtgtaaccacggaatgttttctcttggcaacaatggcatatgatcgctatgtagccatatgcaaacccttactttatccagccattatgaccaatggactgtgcatccggctattaatcttgtcatatgtaggtggtcttcttcatgctttaatccatgaaggatttttattcagactaaccttctgtaactccaacataatacaacacttttactgtgacattatcccattgttaaagatttcttatactgattcctctattaactttctaatggtttttatttttgcaggttcaattcaagtttttaccatagggactgttcttatatcttacatatttgtcctctatacaatcttgaaaaagaagtctgtcaaaggtatgagaaaagccttctccacctgtggagctcatctcttatctgtatctttatactatgggcccctcgccttcatgtatatgggctctgcatccccacaggctgatgaccaagatatgatggagtctctattttacactgtcatagttcctttattaaatcccatgatctacagcctgagaaacaagcaagtaatagcttcattcacaaaaatgttcaaaagaaatgatgtttagatcattactaatatctcttttctatttactaaaatgtcacaaaattgtgcaaattagaggtacctatgtttttgccagcattaaaag

SEQ ID NO: 162318 - DNA, 942 bp, Homo sapiens
  Payload ID: 11853
  Gene Symbol: OR5H15
  Gene Name: olfactory receptor, family 5, subfamily H, member 15
  Uniprot ID: A6NDH6
  ENST ID: ENST00000356526
  CDS Start-End: 1-942
atggaagaggaaaatgcaacattgctgacagagtttgttctcacaggatttttatatcaaccacagtggaaaatacccctgttcttggcattcttggtaatatatctcatcaccatcatggggaatcttggtctgattgctgtcatctggaaagaccctcaccttcatatcccaatgtacttactccttgggaatttagcttttgtggatgcttggatatcatccacagtgaccccaaagatgctgaataacttcttagctaagagtaagatgatatctctctctgaatgcaagatacaatttttttccattgcaattggcgtaaccacagaatgttttctcttggcaacaatggcatatgatcgctatgtagccatatgcaaacctttactttatccagccattatgaccaatggactgtgcatccggctattaatcttgtcatatatagctggtattcttcatgctttaatccatgaaggatttttattcagactaaccttctgtaactccaacatagtacatcacatttactgtgacactatcccattgtctaagatttcttgtactgattcttctattaattttctaatggtttttattttctcaggttcaattcaggtattcagcattgtgactattcttatatcttacacatttgttctcttcacagtcttagaaaagaaatctgataagggtgtaaggaaagccttttccacctgtggagcccatctcttctctgtctgtttatactatggcccccttctcttaatgtatgtgggccctgcatctccgcaagcagatggtcaaaatatggtggagcctctattctacactgtcatcattcctttgttaaatcctatcatctacagtctgagaaataagcaagtcatagtttcattcataaaaatgttaaaaagaaatgttaaggtttcatactaa

SEQ ID NO: 162319 - DNA, 933 bp, Homo sapiens
  Payload ID: 11853
  Gene Symbol: OR5H15
  Gene Name: olfactory receptor, family 5, subfamily H, member 15
  ENST ID: ENST00000615035
  CDS Start-End: 1-933
atggaagaggaaaatgcaacattgctgacagagtttgttctcacaggatttttatatcaaccacagtggaaaatacccctgttcttggcattcttggtaatatatctcatcaccatcatggggaatcttggtctgattgctgtcatctggaaagaccctcaccttcatatcccaatgtacttactccttgggaatttagcttttgtggatgcttggatatcatccacagtgaccccaaagatgctgaataacttcttagctaagagtaagatgatatctctctctgaatgcaagatacaatttttttccattgcaattggcgtaaccacagaatgttttctcttggcaacaatggcatatgatcgctatgtagccatatgcaaacctttactttatccagccattatgaccaatggactgtgcatccggctattaatcttgtcatatatagctggtattcttcatgctttaatccatgaaggatttttattcagactaaccttctgtaactccaacatagtacatcacatttactgtgacactatcccattgtctaagatttcttgtactgattcttctattaattttctaatggtttttattttctcaggttcaattcaagttttcaccattgggactgttcttgtatcttatacatttgtcctctctacaatcttgaaaaagaagtctgtcaaaggcataagaaaagacttctccacctgtggagctcatatcttacctgtatctttatactatgggcccctcgccttcatgtatgtgggctctgcatcccaacgggctgatgaccaagatatgatggagtctctattttacactgtcatagttcctttattaaatcccatgatctacagcctgagaaataagcaagtaatagattcattcacaaaaatgttcaaaggaaataatgtttag

SEQ ID NO: 162320 - DNA, 945 bp, Homo sapiens
  Payload ID: 11854
  Gene Symbol: OR5H2
  Gene Name: olfactory receptor, family 5, subfamily H, member 2
  Uniprot ID: Q8NGV7
  ENST ID: ENST00000355273
  CDS Start-End: 1-945
atgtcgaatgaggacatggaacaggataatacaacattgctgacagagtttgttctcacaggacttacatatcagccagagtggaaaatgcccctgttcttggtgttcttggtgatctatctcatcactattgtgtggaaccttggtctgattgctcttatctggaatgacccacaacttcacatccccatgtacttttttcttgggagtttagcctttgttgatgcttggatatcttccacagtaactcccaaaatgttggttaatttcttggccaaaaacaggatgatatctctgtctgaatgcatgattcaatttttttcctttgcatttggtggaactacagaatgttttctcttggcaacaatggcatatgatcgctatgtagccatatgcaaacctttactatatccagtgattatgaacaattcactatgcatacggctgttagccttctcatttttaggtggcttcctccatgccttaattcatgaagtccttatattcagattaaccttctgcaattctaacataatacatcatttttactgtgatattataccactgtttatgatttcctgtactgacccttctattaattttctaatggtttttattttgtctggctcaattcaggtattcaccattgtgacagttcttaattcttacacatttgctcttttcacaatcctaaaaaagaagtctgttagaggcgtaaggaaagccttttccacctgtggagcccatctcttatctgtctctttatattatggcccacttatcttcatgtatttgcgccctgcatctccacaagcagatgaccaagatatgatagactctgtcttttatacaatcataattcctttgctaaatcccattatctacagtctgagaaataaacaagtaatagattcattcacaaaaatggtaaaaagaaatgtttag

SEQ ID NO: 162321 - DNA, 978 bp, Homo sapiens
  Payload ID: 11855
  Gene Symbol: OR5H6
  Gene Name: olfactory receptor, family 5, subfamily H, member 6 (gene/pseudogene)
  Uniprot ID: Q8NGV6
  ENST ID: ENST00000383696
  CDS Start-End: 1-978
atgttcctttacctttgcttcatttttcagaggacatgcagtgaggagatggaagaggaaaatgcaacattgctgacagagtttgttctcacaggatttttacatcaacctgactgtaaaataccgctcttcctggcattcttggtaatatatctcatcaccatcatggggaatcttggtctaattgttctcatctggaaagaccctcaccttcatatcccaatgtacttattccttgggagtttagcctttgtggatgcttcgttatcatccacagtgactccgaagatgctgatcaacttcttagctaagagtaagatgatatctctctctgaatgcatggtacaatttttttcccttgtaaccactgtaaccacagaatgttttctcttggcaacaatggcatatgatcgctatgtagccatttgcaaagctttactttatccagtcattatgaccaatgaactatgcattcagctattagtcttgtcatttataggtggccttcttcatgctttaatccatgaagctttttcattcagattaaccttctgtaattccaacataatacaacacttttactgtgacattatcccattgttaaagatttcctgtactgattcctctattaactttctaatggtttttattttcgcaggttctgttcaagtttttaccattggaactattcttatatcttatacaattatcctctttacaatcttagaaaagaagtctatcaaagggatacgaaaagctgtctccacctgtggggctcatctcttatctgtatctttatactatggccccctcaccttcaaatatctgggctctgcatctccgcaagcagatgaccaagatatgatggagtctctattttacactgtcatagttcctttattaaatcccatgatctacagcctgagaaacaagcaagtaatagcttcattcacaaaaatgttcaaaagcaatgtttag

SEQ ID NO: 162322 - DNA, 978 bp, Homo sapiens; identical to SEQ ID NO: 162321
  Payload ID: 11855
  Gene Symbol: OR5H6
  Gene Name: olfactory receptor, family 5, subfamily H, member 6 (gene/pseudogene)
  Uniprot ID: Q8NGV6
  ENST ID: ENST00000623942
  CDS Start-End: 1-978

SEQ ID NO: 162323 - DNA, 978 bp, Homo sapiens; identical to SEQ ID NO: 162321
  Payload ID: 11855
  Gene Symbol: OR5H6
  Gene Name: olfactory receptor, family 5, subfamily H, member 6 (gene/pseudogene)
  Uniprot ID: Q8NGV6
  ENST ID: ENST00000623332
  CDS Start-End: 1-978

SEQ ID NO: 162324 - DNA, 931 bp, Homo sapiens
  Payload ID: 11856
  Gene Symbol: OR5H8
  Gene Name: olfactory receptor, family 5, subfamily H, member 8 (gene/pseudogene)
  ENST ID: ENST00000394191
  CDS Start-End: 1-931
atggatgacgaaaatgcaacattgctgacagagtttgttctcacaggacttacatatcaatcagagtggaaaatacccctgttcctggcattcttggtaatatatctcatcaccatcatggcaaatcttggtctgattgctgtcatctggaaagactcacaccttcacattccaatgtacttattccttgggagtttagcctttgtggatgcttggttatcatcctcagtgacccctaagatgctgatcagctttttagctaagagtatgattatttctgtctctgaatgcaagatacaatttttttcctttggaatcagtggaaccacagaatgttttctcttggcaacaatggcatatgatcgctatgtagccatatgcaaacctttactttatccagtcattatgaccaatggactgtgtatctggctattagtcttgtcatttataggtggctttcttcatgccttaattcatgaaggtattttattcagattaaccttctgtaattccaacataatacatcacttttactgtgacattatcccattgttaaagatttcctgtactgacccttctattaattttttaatgctttttattttgtctggttcaatacaggtattcactattttgactgttcttgtctcttatacatttgtcctctttacaatcttaaaaaaaaaagtctgccaaagacataaggaaagccttttccacctgtggagcccatctcttatctgtttctttatactatggcccccttctcttcatgtatgtgcaccctgcatctccacaagcagatgatcaagatatggtggagtctctattttacactgtcataattcctttcttaaatcccattatctacagcctgagaaataagcaagtcatagattcactgacaaaaacattaaaaggaaatgtttag

SEQ ID NO: 162325 - DNA, 945 bp, Homo sapiens
  Payload ID: 11857
  Gene Symbol: OR5I1
  Gene Name: olfactory receptor, family 5, subfamily I, member 1
  Uniprot ID: Q13606
  ENST ID: ENST00000301532
  CDS Start-End: 1-945
atggaatttacagatagaaactacacgttggtcactgagtttattctattaggttttccaactcgccctgaactgcagattgtcctgttcctcatgtttctgacattgtatgctataattctgatagggaacattggattgatgctgttgatcaggattgatcctcaccttcaaacccccatgtattttttccttagcaacctatcatttgtagacctttgctatttctcagacattgttcccaaaatgctggtcaatttcctctcggagaacaaatctatttcctattatgggtgtgccctgcagttttattttttctgtacttttgcagatacagaatccttcatcctggccgccatggcctatgatcgctatgtcgccatctgtaaccctttattgtacacagttgtgatgtctaggggcatctgtatgcggttgattgtcttgtcataccttggaggcaacatgagttccctggttcacacatcctttgcctttattctgaaatattgtgacaaaaatgttattaatcattttttctgtgacctccctcccctgcttaaactatcctgcactgacacaacaattaatgagtggctcctctccacatacggcagctcagtggaaatcatttgttttatcatcatcatcatctcctactttttcattcttctctcagtcttaaagatccgctctttcagtgggaggaagaagaccttttctacatgcgcctctcacctgacttcagtgacgatctaccaagggactctcctctttatttactcacggcccagctacctgtattctccaaacactgataaaattatctcagtgttctacaccattttcattccagtgctgaatccgttgatttatagtttgagaaataaagatgtaaaggatgcagctgagaaagttctaagatcaaaggtagattcttcatga

SEQ ID NO: 162326 - DNA, 939 bp, Homo sapiens
  Payload ID: 11858
  Gene Symbol: OR5J2
  Gene Name: olfactory receptor, family 5, subfamily J, member 2
  Uniprot ID: Q8NH18
  ENST ID: ENST00000312298
  CDS Start-End: 1-939
atggctgatgataattttacagttgtcactgagtttattcttttgggattgacagatcatgctgaactaaaagctgtgctttttgtggtgttcctggtgatttacgccattaccttgttgaggaatctgggcatgatcctcttaatccaaatcacctccaaactccacacacccatgtactttttactcagctgtctttcatttgtggatgcctgctattcatctgcaattgcacccaaaatgctggtgaacctcctggttgtgaaggcaacaatttctttctctgcttgcatggtacagcatttgtgtttcggagtgttcatcaccacagaaggcttcttactgtcagtgatggcctatgaccgctatgtggccattgtgagtcccttgctttacactgtagccatgtctgatagaaagtgtgtggagcttgtcacaggatcatggataggtggaatagttaacacattaatccacacaatcagcttgaggagactgtccttttgtaggctaaatgctgtcagccacttcttctgtgacattccttcactgctaaagctgtcatgttctgacacctccatgaatgagttgttgctgttaaccttctccggagtcattgccatggccaccttcttgactgtgatcatttcctacatcttcattgcttttgctagcctaaggatccactcagcatcaggcagacagcaagccttctccacctgtgcctctcacctgactgctgtgaccatattctatggtaccttaatctttagctacattcagccaagctcccagtattttgtggaacaagagaaagtggtttctatgttctatacgctagggattcccatgttaaacctgttgatacacagtttgagaaacaaggacgtaaaggaggcagtgaaaagggccatagaaatgaaacatttcctctgttaa

SEQ ID NO: 162327 - DNA, 1097 bp, Homo sapiens
  Payload ID: 11859
  Gene Symbol: OR5K1
  Gene Name: olfactory receptor, family 5, subfamily K, member 1
  Uniprot ID: Q8NHB7
  ENST ID: ENST00000332650
  CDS Start-End: 98-1024
tgctctccttcctttaagccaaagagacctaaataactgtggcatattataaattagtgccttctttctccacaattttttttcagacaagtcaggaatggctgaagaaaatcataccatgaaaaatgagtttatcctcacaggatttacagatcaccctgagctgaagactctgctgtttgtggtgttctttgccatctatctgatcaccgtggtggggaatattagtttggtggcactgatatttacacaccgtcggcttcacacaccaatgtacatctttctgggaaatctggctcttgtggattcttgctgtgcctgtgctattacccccaaaatgttagagaacttcttttctgagaacaaaaggatttccctctatgaatgtgcagtacagttttattttctttgcactgtggaaactgcagactgctttcttctggcagcaatggcctatgaccgctatgtggccatatgcaacccactgcagtaccacatcatgatgtccaagaaactctgcattcagatgaccacaggggccttcatagctggaaacctgcattccatgattcatgtagggcttgtatttaggttagttttctgtggatcgaatcacatcaaccacttttactgtgatattcttcccttgtatagactctcttgtgttgatccttatatcaatgaactggttctattcatcttctcaggttcagttcaagtctttaccataggtagtgtcttaatatcttatctctatattcttcttactattttcaaaatgaaatccaaagagggaagggccaaagctttttctacctgtgcatcccactttttgtcagtttcattattctatggatctcttttcttcatgtacgttagaccaaatttgcttgaagaaggggataaagatataccagctgcaattttatttacaatagtagttcccttactaaatcctttcatttatagcctgagaaatagggaagtaataagtgtcttaagaaaaattctgatgaagaaataatctcaagaaagatggaaacaagtgacatctactatagcttaatgatttaaatgcagcaaaaacttccatgtga

SEQ ID NO: 162328 - DNA, 1060 bp, Homo sapiens
  Payload ID: 11860
  Gene Symbol: OR5K2
  Gene Name: olfactory receptor, family 5, subfamily K, member 2
  Uniprot ID: Q8NHB8
  ENST ID: ENST00000427338
  CDS Start-End: 78-1028
caaagagacgtcaataattgtggcatattattaattagtgccttattcctctacaatttttttcagagaggtcaggaatggttgaagaaaatcataccatgaaaaatgagtttatcctcacaggatttacagatcaccctgagctgaagactctgctgtttgtggtgttctttgccatctatctgatcaccgtggtggggaatattagtttggtggcactgatatttacacactgtcggcttcacacaccaatgtacatctttctgggaaatctggctcttgtggattcttgctgtgcctgtgctattacccccaaaatgttagagaacttcttttctgagggcaaaaggatttccctctatgaatgtgcagtacagttttattttctttgcactgtggaaactgcagactgctttcttctggcagcagtggcctatgaccgctatgtggccatctgcaacccactgcagtaccacatcatgatgtccaagaaactctgcattcagatgaccacaggcgccttcatagctggaaatctgcattccatgattcatgtagggcttgtatttaggttagttttctgtggattgaatcacatcaaccacttttactgtgatactcttcccttgtatagactctcctgtgttgaccctttcatcaatgaactggttctattcatcttctcaggttcagttcaagtctttaccataggtagtgtcttaatatcttatctctatattcttcttactattttcagaatgaaatccaaggagggaagggccaaagccttttctacttgtgcatcccacttttcatcagtttcattattctatggatctatttttttcctatacattagaccaaatttgcttgaagaaggaggtaatgatataccagctgctattttatttacaatagtagttcccttactaaatcctttcatttatagtctgagaaacaaggaagtaataagtgtcttaagaaaaattctgctgaaaataaaatctcaaggaagtgtgaacaaatgacatctatcctagcttaatggtttaatgctcaa

SEQ ID NO: 162329 - DNA, 966 bp, Homo sapiens
  Payload ID: 11861
  Gene Symbol: OR5K3
  Gene Name: olfactory receptor, family 5, subfamily K, member 3
  Uniprot ID: A6NET4
  ENST ID: ENST00000383695
  CDS Start-End: 1-966
atgaataaggagaatcactccttgatagctgagttcatcctcacaggatttacatatcatccaaagctgaagactgttctgtttgtggtgttctttgccatctatctgatcaccatggtggggaacattggtttggtggcattgatttatatagagcaacgtcttcacacaccaatgtacatatttttaggcaacctagttctgatggattcctgctgttcctctgctattactcccaagatgttagagaacttcttttctgaggacaaaaggattaccctgtatgaatgtatggcacaattttattttctctgtcttgctgaaactacagactgctttcttctggcggcaatggcctatgactgctatgtggccatatgcaacccactgcagtaccacaccatgatgtccaagacactctgcattcagatgactgcaggagcctacctagctggcaacctgcatcccatgattgaagtagagtttctgttgaggttaactttctgtgggtctcatcaaatcaatcattttttctgtgatgttcttccattatatagactttcttgtattaacccttatatcaatgaattggtgttatttatcttggcaggatcaattcaaatctttactatagtcttagtttcttatttctacatccttttcacaatatttacaatgaaatccaaggagggaagaggcaaagctttatctacttgtgcatctcactttctctctgtgtcaatattctgtgattcccttctcttcatgtatgctcgaccaggtgcagttaatgaaggggataaagatatacctgttgctatattttatactttagttattcctttattaaatccttttatttatagcctaagaaataaggaagtaataaatattatgaaaaaaattatgaagaagagaaaattttgtcacattctgaaacaaatgtcatcccctctggcaacttga

SEQ ID NO: 162330 - DNA, 966 bp, Homo sapiens
  Payload ID: 11862
  Gene Symbol: OR5K4
  Gene Name: olfactory receptor, family 5, subfamily K, member 4
  Uniprot ID: A6NMS3
  ENST ID: ENST00000354924
  CDS Start-End: 1-966
atggctagggaaaatcactccttagcagctgaattcatcctcataggatttacaaattatccagagctgaagacgcttctgtttgtggtgttctctgccatctatctggtcaccatggtggggaatcttggtctggtggcattaatttatgtagagcgtcgtcttctcacaccaatgtacatctttctgggcaacctggctctgatggattcctgctgttcctgtgctgttacccccaagatgttagagaatttcttttctgaggatagaattatttccctgtatgaatgtatggcacaattttattttctctgtcttgctgaaaccacagactgctttcttctggcgacaatggcctatgaccgctatgtggccatatgccacccactgcagtaccacaccatgatgtccaagacgctctgcattcggatgaccacaggggccttcaaagctggaaacctgcattccatgattcatgtagggcttttattaaggttaactttctgcaggtctaataaaattcaccactttttctgtgatattcttccactgtatagactctcctgtacagatccttctattaatgaactaatgatatatatcttttcaataccaattcaaatctttaccattgctactgtcttgatctcttatctctgcatccttttgactgttttcaaaatgaaatccaaggagggaagaggtaaagcattttctacctgtgcatcccactttctctctgtctcaatattttacatttgtcttctcatgtatattggaccatctgaagaaggagataaagatacaccagtggcaatattttatgcaatagtaatcccattactaaacccttttatttatagtctgagaaataaggaggtcataaatgttcttaaaaaaattatgaggaattataacattcttaaacaaacttgctctatagcaaatttatttttaatttattaa

SEQ ID NO: 162331 - DNA, 936 bp, Homo sapiens; identical to SEQ ID NO: 161893
  Payload ID: 11863
  Gene Symbol: OR5L1
  Gene Name: olfactory receptor, family 5, subfamily L, member 1 (gene/pseudogene)
  Uniprot ID: Q8NGL2
  ENST ID: ENST00000333973
  CDS Start-End: 1-936

SEQ ID NO: 162332 - DNA, 936 bp, Homo sapiens
  Payload ID: 11864
  Gene Symbol: OR5L2
  Gene Name: olfactory receptor, family 5, subfamily L, member 2
  Uniprot ID: Q8NGL0
  ENST ID: ENST00000378397
  CDS Start-End: 1-936
atgggcaaggaaaactgcaccactgtggctgagttcattctccttggactatcagatgtccctgagttgagagtctgcctcttcctgctgttccttctcatctatggagtcacgttgttagccaatctgggcatgactgcactgattcaggtcagctctcggctccacacccccgtgtactttttcctcagccacttgtcctttgtagatttctgctactcctcaataattgtgccaaagatgttggctaatatctttaacaaggacaaagccatctccttcctagggtgcatggtgcaattctacttgttttgcacatgtggagtcactgaggtcttcctgctggccgtgatggcctatgaccgctttgtggccatctgtaaccccctgctgtacatggtgaccatgtctcagaagctgcgtgtggagctgacctcttgctgctacttctgtgggacggtgtgttctctgattcactcgtccttagctcttaggatcctcttctatagatctaatgtgattaaccacttcttctgtgatctaccccctctcctaagtcttgcttgctctgatgtcactgtgaatgagacactgctgttcctggtggccactttgaatgagagtgttaccatcatgatcatcctcacctcctacctgctaattctcaccactatcctgaagatacactctgcagagagcaggcacaaagctttctccacctgtgcctcccacctcacagccatcactgtctcccatggaacaatcctttacatttattgcaggccgagttcaggcaacagtggagatgttgacaaagtggccaccgtgttctacacagttgtgattcccatgctgaaccccctgatctacagcctgagaaataaggatgtgaacaaagctctcagaaaagtgatgggctccaaaattcactcctag

SEQ ID NO: 162333 - DNA, 948 bp, Homo sapiens
  Payload ID: 11865
  Gene Symbol: OR5M1
  Gene Name: olfactory receptor, family 5, subfamily M, member 1
  Uniprot ID: Q8NGP8
  ENST ID: ENST00000526538
  CDS Start-End: 1-948
atgttctccccaaaccacaccatagtgacagaattcattctcttgggactgacagacgacccagtgctagagaagatcctgtttggggtattccttgcgatctacctaatcacactggcaggcaacctgtgcatgatcctgctgatcaggaccaattcccacctgcaaacacccatgtatttcttccttggccacctctcctttgtagacatttgctattcttccaatgttactccaaatatgctgcacaatttcctctcagaacagaagaccatctcctacgctggatgcttcacacagtgtcttctcttcatcgccctggtgatcactgagttttacatccttgcttcaatggcattggatcgctatgtagccatttgcagccctttgcattacagttccaggatgtccaagaacatctgtgtctgtctggtcactatcccttacatgtatgggtttcttagtgggttctctcagtcactgctaacctttcacttatccttctgtggctcccttgaaatcaatcatttctactgcgctgatcctcctcttatcatgctggcctgctctgacacccgtgtcaaaaagatggcaatgtttgtagttgcaggctttaatctctcaagctctctcttcatcattcttctgtcctatcttttcatttttgcagcgatcttcaggatccgttctgctgaaggcaggcacaaagccttttctacgtgtgcttcccacctgacaatagtcactttgttttatggaaccctcttctgcatgtacgtaaggcctccatcagagaagtctgtagaggagtccaaaataactgcagtcttttatacttttttgagcccaatgctgaacccattgatctatagcctacggaacacagatgtaatccttgccatgcaacaaatgattaggggaaaatcctttcataaaattgcagtttag

SEQ ID NO: 162334 - DNA, 948 bp, Homo sapiens
  Payload ID: 11866
  Gene Symbol: OR5M10
  Gene Name: olfactory receptor, family 5, subfamily M, member 10
  Uniprot ID: Q6IEU7
  ENST ID: ENST00000526812
  CDS Start-End: 1-948
atgttgtccccaaaccacaccatagtgacagaattcattctcttaggactgacagacgacccagtgctagagaagatcctgtttggggtgttcctggcgatctacctaatcacactggcaggcaacctgtgcatgatcctgctgatcaggaccaattcccaactgcaaacacccatgtatttcttccttggtcacctctcctttgtagacatttgctattcttccaatgttactccaaatatgctgcacaatttcctctcagaacagaagaccatctcctacgctggatgcttcacacagtgtcttctcttcatcgccctagtgatcactgagttttacttccttgcttcaatggcattggatcgctatgtagccatttgcagccctttacattacagttccaggatgtccaagaacatttgcatctctctggtcactgtgccttacatgtatggcttccttaatgggctctctcagacactgctgacctttcacttatccttctgtggctcccttgaaatcaatcatttctactgcgctgatcctcctcttatcatgctggcctgctctgacacccgtgtcaaaaagatggcaatgtttgtagttgcaggctttactctctcaagctctctcttcatcattcttctgtcctatcttttcatttttgcagcgatcttcaggatccgttctgctgaaggcaggcacaaagccttttctacgtgtgcttcccacctgacaatagtcactttgttttatggaaccctcttctgcatgtacgtaaggcctccatcagagaagtctgtagaggagtccaaaataattgcagtcttttatacttttttgagcccaatgctgaacccattgatctatagcctacggaacagagatgtaatccttgccatacaacaaatgattaggggaaaatccttttgtaaaattgcagtttag

SEQ ID NO: 162335 - DNA, 918 bp, Homo sapiens
  Payload ID: 11867
  Gene Symbol: OR5M11
  Gene Name: olfactory receptor, family 5, subfamily M, member 11
  Uniprot ID: Q96RB7
  ENST ID: ENST00000528616
  CDS Start-End: 1-918
atgtccaacacaaatggcagtgcaatcacagaattcattttacttgggctcacagattgcccggaactccagtctctgctttttgtgctgtttctggttgtttacctcgtcaccctgctaggcaacctgggcatgataatgttaatgagactggactctcgccttcacacgcccatgtacttcttcctcactaacttagcctttgtggatttgtgctatacatcaaatgcaaccccgcagatgtcgactaatatcgtatctgagaagaccatttcctttgctggttgctttacacagtgctacattttcattgcccttctactcactgagttttacatgctggcagcaatggcctatgaccgctatgtggccatatatgaccctctgcgctacagtgtgaaaacgtccaggagagtttgcatctgcttggccacatttccctatgtctatggcttctcagatggactcttccaggccatcctgaccttccgcctgaccttctgtagatccagtgtcatcaaccacttctactgtgctgacccgccgctcattaagctttcttgttctgatacttatgtcaaagagcatgccatgttcatatctgctggcttcaacctctccagctccctcaccatcgtcttggtgtcctatgccttcattcttgctgccatcctccggatcaaatcagcagagggaaggcacaaggcattctccacctgtggttcccatatgatggctgtcaccctgttttatgggactctcttttgcatgtatataagaccaccaacagataagactgttgaggaatctaaaataatagctgtcttttacacctttgtgagtccggtacttaatccattgatctacagtctgaggaataaagatgtgaagcaggccttgaagaatgtcctgagatga

SEQ ID NO: 162336 - DNA, 924 bp, Homo sapiens
  Payload ID: 11868
  Gene Symbol: OR5M3
  Gene Name: olfactory receptor, family 5, subfamily M, member 3
  Uniprot ID: Q8NGP4
  ENST ID: ENST00000312240
  CDS Start-End: 1-924
atgctcaatttcaccgatgtgacagagttcattcttttggggctaacgagccgtcgagaatggcaagttctcttcttcatcatctttcttgtggtctacatcatcaccatggtgggcaatatcggcatgatggtgttaatcaaggtcagtcctcagcttaacaaccccatgtactttttcctcagtcacttgtcatttgttgatgtgtggttttcttccaatgtcacccctaaaatgttggaaaacctgttatcagataaaaaaacaattacttatgctggttgtttagtacagtgtttcttcttcattgctcttgtccatgtggaaatttttattcttgctgcgatggcctttgatagatacatggcaattgggaatcctctgctttatggcagtaaaatgtcaagggttgtctgtattcgactgattactttcccttacatttatggttttctgacgagtctggcagcaacattatggacttacggcttgtacttctgtggaaaaattgagatcaaccatttctactgtgcagatccacctctcatcaaaatggcctgtgctgggacctttgtaaaagaatatacaatgatcatacttgccggcattaacttcacatattccctgactgtaattatcatctcttacttattcatcctcattgccattctgcgaatgcgctcagcagaaggaaggcagaaggccttttccacatgtgggtcccatctgacagctgtcattatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaa

SEQ ID NO: 162337 - DNA, 936 bp, Homo sapiens
  Payload ID: 11869
  Gene Symbol: OR5M8
  Gene Name: olfactory receptor, family 5, subfamily M, member 8
  Uniprot ID: Q8NGP6
  ENST ID: ENST00000327216
  CDS Start-End: 1-936
atgagaagaaactgcacgttggtgactgagttcattctcctgggactgaccagtcgccgggaattacaaattctcctcttcacgctgtttctggccatttacatggtcacggtggcagggaaccttggcatgattgtcctcatccaggccaacgcctggctccacatgcccatgtactttttcctgagccacttatccttcgtggatctgtgcttctcttccaatgtgactccaaagatgctggagattttcctttcagagaagaaaagcatttcctatcctgcctgtcttgtgcagtgttacctttttatcgccttggtccatgttgagatctacatcctggctgtgatggcctttgaccggtacatggccatctgcaaccctctgctttatggcagcagaatgtccaagagtgtgtgctccttcctcatcacggtgccttatgtgtatggagcgctcactggcctgatggagaccatgtggacctacaacctagccttctgtggccccaatgaaattaatcacttctactgtgcggacccaccactgattaagctggcttgttctgacacctacaacaaggagttgtcaatgtttattgtggctggctggaacctttctttttctctcttcatcatatgtatttcctacctttacattttccctgctattttaaagattcgctctacagagggcaggcaaaaagctttttctacctgtggctcccatctgacagctgtcactatattctatgcaacccttttcttcatgtatctcagacccccctcaaaggaatctgttgaacagggtaaaatggtagctgtattttataccacagtaatccctatgctgaaccttataatttatagccttagaaataaaaatgtaaaagaagcattaatcaaagagctgtcaatgaagatatacttttcttaa

SEQ ID NO: 162338 - DNA, 933 bp, Homo sapiens
  Payload ID: 11870
  Gene Symbol: OR5M9
  Gene Name: olfactory receptor, family 5, subfamily M, member 9
  Uniprot ID: Q8NGP3
  ENST ID: ENST00000279791
  CDS Start-End: 1-933
atgcctaatttcacggatgtgacagaatttactctcctggggctgacctgtcgtcaggagctacaggttctcttttttgtggtgttcctagcggtttacatgatcactctgttgggaaatattggtatgatcattttgattagcatcagtcctcagcttcagagtcccatgtactttttcctgagtcatctgtcttttgcggacgtgtgcttctcctccaacgttacccccaaaatgctggaaaacttattatcagagacaaaaaccatttcctatgtgggatgcttggtgcagtgctactttttcattgccgttgtccacgtggaggtctatatcctggctgtgatggcctttgacaggtacatggccggctgcaaccctctgctttatggcagtaaaatgtctaggactgtgtgtgttcggctcatctctgtgccttatgtctatggattctctgtcagcctaatatgcacactatggacttatggcttatacttctgtggaaactttgaaatcaatcacttctattgtgcagatccccctctcatccagattgcctgtgggagagtgcacatcaaagaaatcacaatgattgttattgctggaattaacttcacatattccctctcggtggtcctcatctcctacactctcattgtagtagctgtgctacgcatgcgctctgccgatggcaggaggaaggcgttctccacctgtgggtcccacttgacggctgtttctatgttttatgggacccccatcttcatgtatctcaggagacccactgaggaatccgtagagcagggcaaaatggtggctgtgttttacaccacagtaattcctatgttgaatcccatgatctacagtctgagaaataaggatgtaaaagaagcagtcaacaaagcaatcaccaagacatatgtgaggcagtaa

SEQ ID NO: 162339 - DNA, 1069 bp, Homo sapiens
  Payload ID: 11871
  Gene Symbol: OR5P2
  Gene Name: olfactory receptor, family 5, subfamily P, member 2
  Uniprot ID: Q8WZ92
  ENST ID: ENST00000329434
  CDS Start-End: 32-1000
gggttcatttagtcagcagctacttcgtctcatgaattccctgaaggacgggaatcacaccgctctgacggggttcatcctattgggcttaacagatgatccaatccttcgagtcatcctcttcatgatcatcctatctggtaatctcagcataattattcttatcagaatttcttctcagctccatcatcctatgtatttctttctgagccacttggcttttgctgacatggcctattcatcttctgtcacacccaacatgcttgtaaacttcctggtggagagaaatacagtctcctaccttggatgtgccatccagcttggttcagcggctttctttgcaacagtcgaatgcgtccttctggctgccatggcctatgaccgctttgtggcaatttgcagtccactgctttattcaaccaaaatgtccacacaagtcagtgtccagctactcttagtagtttacatagctggttttctcattgctgtctcctatactacttccttctattttttactcttctgtggaccaaatcaagtcaatcattttttctgtgatttcgctcccttacttgaactctcctgttctgatatcagtgtctccacagttgttctctcattttcttctggatccatcattgtggtcactgtgtgtgtcatagccgtctgctacatctatatcctcatcaccatcctgaagatgcgctccactgaggggcaccacaaggccttctccacctgcacttcccacctcactgtggttaccctgttctatgggaccattaccttcatttatgtgatgcccaattttagctactcaactgaccagaacaaggtggtgtctgtgttgtacacagtggtgattcccatgttgaaccccctgatctacagcctcaggaacaaggagattaagggggctctgaagagagagcttgttagaaaaatactttctcatgatgcttgttattttagtagaacttcaaataatgatattacatagaaccctatctcttctcttgagaatactcaatgcacgtgtagatacagatttagtgtttgctttcttgac

SEQ ID NO: 162340 - DNA, 1069 bp, Homo sapiens; identical to SEQ ID NO: 162339
  Payload ID: 11871
  Gene Symbol: OR5P2
  Gene Name: olfactory receptor, family 5, subfamily P, member 2
  Uniprot ID: Q8WZ92
  ENST ID: ENST00000611603
  CDS Start-End: 32-1000

SEQ ID NO: 162341 - DNA, 1069 bp, Homo sapiens; identical to SEQ ID NO: 162339
  Payload ID: 11871
  Gene Symbol: OR5P2
  Gene Name: olfactory receptor, family 5, subfamily P, member 2
  Uniprot ID: Q8WZ92
  ENST ID: ENST00000625920
  CDS Start-End: 32-1000

SEQ ID NO: 162342 - DNA, 936 bp, Homo sapiens
  Payload ID: 11872
  Gene Symbol: OR5P3
  Gene Name: olfactory receptor, family 5, subfamily P, member 3
  Uniprot ID: Q8WZ94
  ENST ID: ENST00000328375
  CDS Start-End: 1-936
atggggactggaaatgacaccactgtggtagagtttactcttttggggttatctgaggatactacagtttgtgctattttatttcttgtgtttctaggaatttatgttgtcaccttaatgggtaatatcagcataattgtattgatcagaagaagtcatcatcttcatacacccatgtacattttcctctgccatttggcctttgtagacattgggtactcctcatcagtcacacctgtcatgctcatgagcttcctaaggaaagaaacctctctccctgttgctggttgtgtggcccagctctgttctgtagtgacgtttggtacggccgagtgcttcctgctggctgccatggcctatgatcgctatgtggccatctgctcacccctgctctactctacctgcatgtcccctggagtctgcatcatcttagtgggcatgtcctacctgggtggatgtgtgaatgcttggacattcattggctgcttattaagactgtccttctgtgggccaaataaagtcaatcactttttctgtgactattcaccacttttgaagcttgcttgttcccatgattttacttttgaaataattccagctatctcttctggatctatcattgtggccactgtgtgtgtcatagccatatcctacatctatatcctcatcaccatcctgaagatgcactccaccaagggccgccacaaggccttctccacctgcacctcccacctcactgcagtcactctgttctatgggaccattaccttcatttatgtgatgcccaagtccagctactcaactgaccagaacaaggtggtgtctgtgttctacaccgtggtgattcccatgttgaaccccctgatctacagcctcaggaacaaggagattaagggggctctgaagagagagcttagaataaaaatattttcttga

SEQ ID NO: 162343 - DNA, 936 bp, Homo sapiens; identical to SEQ ID NO: 162342
  Payload ID: 11872
  Gene Symbol: OR5P3
  Gene Name: olfactory receptor, family 5, subfamily P, member 3
  Uniprot ID: Q8WZ94
  ENST ID: ENST00000619725
  CDS Start-End: 1-936

SEQ ID NO: 162344 - DNA, 936 bp, Homo sapiens
  Payload ID: 11872
  Gene Symbol: OR5P3
  Gene Name: olfactory receptor, family 5, subfamily P, member 3
  Uniprot ID: Q8WZ94
  ENST ID: ENST00000630502
  CDS Start-End: 1-936
atggggactggaaatgacaccactgtggtagagtttactcttttgggattatccgaggatactacagtttgtgctattttatttcttgtgtttctaggaatttatgttgtcaccttaatgggtaatatcagcataattgtattgatcagaagaagtcatcatcttcatacacccatgtacattttcctctgccatttggcctttgtagacattgggtactcctcatcagtcacacctgtcatgctcatgagcttcctaaggaaagaaacctctctccctgttgctggttgtgtggcccagctctgttctgtggtgacgtttggtacggccgagtgcttcctgctggctgccatggcctatgatcgctatgtggccatctgctcacccctgctctactctacctgcatgtcccctggagtctgcatcatcttagtgggcatgtcctacctgggtggatgtgtgaatgcttggacattcattggctgcttattaagactgtccttctgtgggccaaataaagtcaatcactttttctgtgactattcaccacttttgaagcttgcttgttcccatgattttacttttgaaataattccagctatctcttctggatctatcattgtggccactgtgtgtgtcatagccatatcctacatctatatcctcatcaccatcctgaagatgcactccaccaagggccgccacaaggccttctccacctgcacctcccacctcactgcagtcactctgttctatgggaccattaccttcatttatgtgatgcccaagtccagctactcaactgaccagaacaaggtggtgtctgtgttctacaccgtggtgattcccatgttgaaccccctgatctacagcctcaggaacaaggagattaagggggctctgaagagagagcttagaataaaaatattttcttga

SEQ ID NO: 162345 - DNA, 975 bp, Homo sapiens; identical to SEQ ID NO: 161895
  Payload ID: 11873
  Gene Symbol: OR5R1
  Gene Name: olfactory receptor, family 5, subfamily R, member 1 (gene/pseudogene)
  Uniprot ID: Q8NH85
  ENST ID: ENST00000312253
  CDS Start-End: 1-975

SEQ ID NO: 162346 - DNA, 981 bp, Homo sapiens
  Payload ID: 11874
  Gene Symbol: OR5T1
  Gene Name: olfactory receptor, family 5, subfamily T, member 1
  Uniprot ID: Q8NG75
  ENST ID: ENST00000313033
  CDS Start-End: 1-981
atgtcagggttgccttcagatatggatctatacaagcttcaattaaacaattttactgaagtcaccatgtttatattaataagcttcacagaagaatttgatgtgcaagtcttcctatttttattatttttagcaatctatctattcactctaataggcaatttagggctggttgtaccgatcattggggatttctggcttcacagcccaatgtactattttcttggtgttttatcattcttggatgtctgctattctacagttgtcactccaaaaatgttggtcaatttcctggcaaaaaataaatctatttcatttcttggatgtgcaacacagatgtttcttgcttgtacttttggaaccacagaatgctttctcttggctgcaatggcttatgatcgctatgtagccatctacaaccctctcctgtattcagtgagcatgtcacccagagtctatgtgccactcatcactgcttcctatgttgctagcattttacatgctactatacatacagtggctacatttagcctgtccttctgtggatccaatgaaattaggcatgtcttttgtaatatgcctcctctgcttgctatttcttgttctgacactcacgtaatccagcttctattcttctactttgtgggctctattgagatagtcactatcctgattgtcctgatctcctatggttttattctgttggccattctgaagatgcagtctgctgaagggaggagaaaagtcttctctacatgtggagctcacctaactggagtgacaatttatcatgggacaatcctcttcatgtatgtgagaccaagttccagctacacttcggacaatgacatgatagtgtcaatattttataccattgtgattcccatgctgaatcccatcatctacagtttgcggaacaaagatgtaaaggaggcaatcaaaagattgcttgtgagaaattggttcataaataagttatag

SEQ ID NO: 162347 - DNA, 981 bp, Homo sapiens; identical to SEQ ID NO: 162346
  Payload ID: 11874
  Gene Symbol: OR5T1
  Gene Name: olfactory receptor, family 5, subfamily T, member 1
  Uniprot ID: Q8NG75
  ENST ID: ENST00000576733
  CDS Start-End: 1-981

SEQ ID NO: 162348 - DNA, 1080 bp, Homo sapiens
  Payload ID: 11875
  Gene Symbol: OR5T2
  Gene Name: olfactory receptor, family 5, subfamily T, member 2
  Uniprot ID: Q8NGG2
  ENST ID: ENST00000313264
  CDS Start-End: 1-1080
atgtcgtacagtatatacaagagcacagttaacatccccttgagtcatggtgttgttcattctttttgtcataatatgaactgtaactttatgcatatcttcaagtttgttctagatttcaacatgaagaatgtcactgaagttaccttatttgtactgaagggcttcacagacaatcttgaactgcagactatcttcttcttcctgtttctagcaatctacctcttcactctcatgggaaatttaggactgattttagtggtcattagggattcccagctccacaaacccatgtactattttctgagtatgttgtcttctgtggatgcctgctattcctcagttattaccccaaatatgttagtagattttacgacaaagaataaagtcatttcattccttggatgtgtagcacaggtgtttcttgcttgtagttttggaaccacagaatgctttctcttggctgcaatggcttatgatcgctatgtagccatctacaaccctctcctgtattcagtgagcatgtcacccagagtctacatgccactcatcaatgcttcctatgttgctggcattttacatgctactatacatacagtggctacatttagcctatccttctgtggagccaatgaaattaggcgtgtcttttgtgatatccctcctctccttgctatttcttattctgacactcacacaaaccagcttctactcttctactttgtgggctctatcgagctggtcactatcctgattgttctgatctcctatggtttgattctgttggccattctgaagatgtattctgctgaagggaggagaaaagtcttctccacatgtggagctcacctaactggagtgtcaatttattatgggacaatcctcttcatgtatgtgagaccaagttccagctatgcttcggaccatgacatgatagtgtcaatattttacaccattgtgattcccttgctgaatcccgtcatctacagtttgaggaacaaagatgtaaaagactcaatgaaaaaaatgtttgggaaaaatcaggttatcaataaagtatattttcatactaaaaaataa

SEQ ID NO: 162349 - DNA, 1080 bp, Homo sapiens; identical to SEQ ID NO: 162348
  Payload ID: 11875
  Gene Symbol: OR5T2
  Gene Name: olfactory receptor, family 5, subfamily T, member 2
  Uniprot ID: Q8NGG2
  ENST ID: ENST00000573647
  CDS Start-End: 1-1080

SEQ ID NO: 162350 - DNA, 1023 bp, Homo sapiens
  Payload ID: 11876
  Gene Symbol: OR5T3
  Gene Name: olfactory receptor, family 5, subfamily T, member 3
  Uniprot ID: Q8NGG3
  ENST ID: ENST00000303059
  CDS Start-End: 1-1023
atggactccactttcacaggctataacctttataacctgcaagtaaaaactgaaatggacaagttgtcatcaggtttggatatatacaggaatccactgaagaacaagactgaagtcaccatgtttatattgacaggcttcacagatgattttgagctgcaagtcttcctatttttactattttttgcaatctatctctttaccttgataggcaatttagggctggttgtgttggtcattgaggattcctggctccacaaccccatgtattattttcttagtgttttatcattcttggatgcttgctattctacagttgtcactccaaaaatgttggtcaatttcctggcaaaaaataaatccatttcatttatcggatgtgcaacacagatgcttctttttgttacttttggaactacagaatgttttctcttggctgcaatggcttatgatcactatgtagccatctacaaccctctcctgtattcagtgagcatgtcacccagagtctatgtgccactcatcactgcttcctacgttgctggcattttacatgctactatacatatagtggctacatttagcctgtccttctgtggatccaatgaaattaggcatgtcttttgtgatatgcctcctctccttgctatttcttgttctgacactcacacaaaccagcttctactcttctactttgtgggttctattgagatagtcactatcctgattgtcctcatttcctgtgatttcattctgttgtccattctgaagatgcattctgctaagggaaggcaaaaggccttctctacatgtggctctcacctaactggagtgacaatttatcatggaacaattctcgtcagttatatgagaccaagttccagctatgcttcagaccatgacatcatagtgtcaatattttacacaattgtgattcccaagttgaatcccatcatctatagtttgaggaacaaagaagtaaaaaaggcagtgaagaaaatgttgaaattggtttacaaatga

SEQ ID NO: 162351 - DNA, 1023 bp, Homo sapiens; identical to SEQ ID NO: 162350
  Payload ID: 11876
  Gene Symbol: OR5T3
  Gene Name: olfactory receptor, family 5, subfamily T, member 3
  Uniprot ID: Q8NGG3
  ENST ID: ENST00000575738
  CDS Start-End: 1-1023

SEQ ID NO: 162352 - DNA, 1048 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000230223
  CDS Start-End: 83-1048
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaatggcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162353 - DNA, 1266 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000377154
  CDS Start-End: 301-1266
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttctctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162354 - DNA, 1266 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000400698
  CDS Start-End: 301-1266
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaatggcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162355 - DNA, 1266 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000446761
  CDS Start-End: 301-1266
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162356 - DNA, 1117 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000441440
  CDS Start-End: 152-1117
gaaatacgttgtgaacttcccagcacatctgttagaaaggaggtccagaaaaagagcacaaagagaatggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162357 - DNA, 1117 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000458372
  CDS Start-End: 152-1117
gaaatacgttgtgaacttcccagcacatctgttagaaaggaggtccagaaaaagagcacaaagagaatggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcgtttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162358 - DNA, 1266 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000444009
  CDS Start-End: 301-1266
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgacatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcgtttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162359 - DNA, 1266 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000421859
  CDS Start-End: 301-1266
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaatgatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaggctgtcaaaactatagggagcaagtggcagccaccaatttcctctttggatagtaaactcacttattga

SEQ ID NO: 162360 - DNA, 1117 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000418692
  CDS Start-End: 152-1117
gaaatacgttgtgaacttcccagcacatctgttagaaaggaggtccagaaaaagagcacaaagagaatggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaatgatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaggctgtcaaaactatagggagcaagtggcagccaccaatttcctctttggatagtaaactcacttattga

SEQ ID NO: 162361 - DNA, 1048 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000543825
  CDS Start-End: 83-1048
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttctctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162362 - DNA, 1048 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000550240
  CDS Start-End: 83-1048
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcgtttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162363 - DNA, 1048 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000548546
  CDS Start-End: 83-1048
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaatgatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaggctgtcaaaactatagggagcaagtggcagccaccaatttcctctttggatagtaaactcacttattga

SEQ ID NO: 162364 - DNA, 1048 bp, Homo sapiens
  Payload ID: 11877
  Gene Symbol: OR5V1
  Gene Name: olfactory receptor, family 5, subfamily V, member 1
  Uniprot ID: Q9UGF6
  ENST ID: ENST00000549299
  CDS Start-End: 83-1048
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 162365 - DNA, 933 bp, Homo sapiens
  Payload ID: 11878
  Gene Symbol: OR5W2
  Gene Name: olfactory receptor, family 5, subfamily W, member 2
  Uniprot ID: Q8NH69
  ENST ID: ENST00000344514
  CDS Start-End: 1-933
atggactgggaaaattgctcctcattaactgatttttttctcttgggaattaccaataacccagagatgaaagtgaccctatttgctgtattcttggctgtttatatcattaatttctcagcaaatcttggaatgatagttttaatcagaatggattaccaacttcacacaccaatgtatttcttcctcagtcatctgtctttctgtgatctctgctattctactgcaactgggcccaagatgctggtagatctacttgccaagaacaagtcaatacccttctatggctgtgctctgcaattcttggtcttctgtatctttgcagattctgagtgtctactgctgtcagtgatggcctttgatcggtacaaggccatcatcaaccccctgctctatacagtcaacatgtctagcagagtgtgctatctactcttgactggggtttatctggtgggaatagcagatgctttgatacatatgacactggccttccgcctatgcttctgtgggtctaatgagattaatcatttcttctgtgatatccctcctctcttattactctctcgctcagatacacaggtcaatgagttagtgttattcaccgtctttggttttattgaactgagtaccatttcaggagttttcatttcttattgttatatcatcctatcagtcttggagatacactctgctgaggggaggttcaaagctctctctacatgcacttcccacttatctgcggttgcaattttccagggaactctgctctttatgtatttccggccaagttcttcctattctctagatcaagataaaatgacctcattgttttacacccttgtggttcccatgttgaaccccctgatttatagcctgaggaacaaggatgtgaaagaggccctgaaaaaactgaaaaataaaattttattttaa

SEQ ID NO: 162366 - DNA, 942 bp, Homo sapiens
  Payload ID: 11879
  Gene Symbol: OR51A2
  Gene Name: olfactory receptor, family 51, subfamily A, member 2
  Uniprot ID: Q8NGJ7
  ENST ID: ENST00000380371
  CDS Start-End: 1-942
atgtccattatcaacacatcatatgttgaaatcaccaccttcttcttggttgggatgccagggctagaatatgcacacatctggatctctatccccatctgcagcatgtatcttattgctattctaggaaatggcaccattctttttatcatcaagacagagccctccttgcatgggcccatgtactattttctttccatgttggctatgtcagacttgggtttgtctttatcatctctgcccactgtgttaagcatcttcctgttcaatgcccctgaaacttcttctagtgcctgctttgcccaggaattcttcattcatggattctcagtactggagtcctcagtcctcctgatcatgtcatttgatagattcctagccatccacaatcctctgagatacacctcaatcctgacaactgtcagagttgcccaaatagggatagtattctcctttaagagcatgctcctggttcttcccttccctttcactttaagaagcttgagatattgcaagaaaaaccaattatcccattcctactgtctccaccaggatgtcatgaagttggcctgttctgacaacagaattgatgttatctatggcttttttggagcactctgccttatggtagactttattctcattgctgtgtcttacaccctgatcctcaagactgtaccgggaattgcatccaaaaaggaggagcttaaggctctcaatacttgtgtttcacacatctgtgcagtgatcatcttctacctgcccatcatcaacctggccgttgtccaccgctttgccgggcatgtctctcccctcattaatgttctcatggcaaatgttctcctacttgtacctccgctgatgaaaccaattgtttattgtgtaaaaactaaacagattagagtgagagttgtagcaaaattgtgtcaatggaagatttaa

SEQ ID NO: 162367 - DNA, 942 bp, Homo sapiens
  Payload ID: 11880
  Gene Symbol: OR51A4
  Gene Name: olfactory receptor, family 51, subfamily A, member 4
  Uniprot ID: Q8NGJ6
  ENST ID: ENST00000380373
  CDS Start-End: 1-942
atgtccattatcaacacatcatatgttgaaatcaccaccttcttcttggttgggatgccagggctagaatatgcacacatctggatctctatccccatctgcagcatgtatcttattgctattctaggaaatggcaccattctttttatcatcaagacagagccctccttgcatgagcccatgtactattttctttccatgttggctatgtcagacttgggtttgtctttatcatctctgcccactgtgttaagcatcttcctgttcaatgctcctgaaatttcatccaatgcctgctttgcccaggaattcttcattcatggattctcagtactggagtcctcagtcctcctgatcatgtcatttgatagattcctagccatccacaaccctctgagatacacctcaatcctgacaactgtcagagttgcccaaatagggatagtattctcctttaagagcatgctcctggttcttcccttccctttcactttaagaaacttgagatattgcaagaaaaaccaattatcccattcctactgtctccaccaggatgtcatgaagttggcctgttctgacaacagaattgatgttatctatggcttttttggagcactctgccttatggtagactttattctcattgctgtgtcttacaccctgatcctcaagactgtactgggaattgcatccaaaaaggagcagcttaaggctctcaatacttgtgtttcacacatctgtgcagtgatcatcttctacctgcccatcatcaacctggccgttgtccaccgctttgcccggcatgtctctcccctcattaatgttctcatggcaaatgttctcctacttgtacctccactgacgaacccaattgtttattgtgtaaaaactaaacagattagagtgagagttgtagcaaaattgtgtcaacggaagatttaa

SEQ ID NO: 162368 - DNA, 939 bp, Homo sapiens
  Payload ID: 11881
  Gene Symbol: OR51A7
  Gene Name: olfactory receptor, family 51, subfamily A, member 7
  Uniprot ID: Q8NH64
  ENST ID: ENST00000359350
  CDS Start-End: 1-939
atgtctgttctcaataactccgaagtcaagcttttccttctgattgggatcccaggactggaacatgcccacatttggttctccatccccatttgcctcatgtacctgcttgccatcatgggcaactgcaccattctctttattataaagacagagccctcgcttcatgagcccatgtattatttccttgccatgttggctgtctctgacatgggcctgtccctctcctcccttcctaccatgttgagggtcttcttgttcaatgccatgggaatttcacctaatgcctgctttgctcaagaattcttcattcatggattcactgtcatggaatcctcagtacttctaattatgtctttggaccgctttcttgccattcacaatcccttaagatacagttctatcctcactagcaacagggttgctaaaatgggacttattttagccattaggagcattctcttagtgattccatttcccttcaccttaaggagattaaaatattgtcaaaagaatcttctttctcactcatactgtcttcatcaggataccatgaagctggcctgctctgacaacaagaccaatgtcatctatggcttcttcattgctctctgtactatgctggacttggcactgattgttttgtcttatgtgctgatcttgaagactatactcagcattgcatctttggcagagaggcttaaggccctaaatacctgtgtctcccacatctgtgctgtgctcaccttctatgtgcccatcatcaccctggctgccatgcatcactttgccaagcacaaaagccctcttgttgtgatccttattgcagatatgttcttgttggtgccgccccttatgaaccccattgtgtactgtgtaaagactcgacaaatctgggagaagatcttggggaagttgcttaatgtatgtgggagataa

SEQ ID NO: 162369 - DNA, 939 bp, Homo sapiens
  Payload ID: 11882
  Gene Symbol: OR51B2
  Gene Name: olfactory receptor, family 51, subfamily B, member 2 (gene/pseudogene)
  Uniprot ID: Q9Y5P1
  ENST ID: ENST00000328813
  CDS Start-End: 1-939
atgtggcccaatattactgcagccccttttttgctgactggctttccagggctggaggcagctcatcactggatctccatccccttctttgctgtttatgtgtgcatccttctgggcaatggcatgctcctctacctcatcaagcatgaccacagtcttcatgagcccatgtactacttcctcaccatgctggcaggcacagacctcatggtgacattgaccacgatgcctactgtaatgggcatcctatgggtgaatcacagggagattagcagtgtgggctgcttcctacaggcttactttattcactccctttctgttgtggaatcaggttccctcctggcaatggcatatgattgtttcattgccatccgcaatcctttgagatatgcttccattctcaccaatactagagtcatagcgttaggagtgggagtgtttctaaggggttttgtatccatcctgcctgtaattttgcgtcttttttcattttcatattgcaaatctcatgttatcacacgtgctttctgcctccaccaagaaatcatgagactggcttgtgctgacataactttcaatagactttaccctgtaattttgatctctttaacaatcttcctagactgtctgatcatcctcttctcctatattctaattcttaatactgtcataggcattgcttctggtgaagagagagccaaagccctcaatacctgtatctcccacattagttgtgttcttatcttctatgttacagtgatgggtttgacattcatttacagatttgggaagaatgtgccagaggttgtccacattatcatgagttacatctacttcctctttcctcctttaatgaaccctgtcatctacagcatcaaaaccaagcaaatacaatatggcattatccgccttttatctaaacataggtttagtagttaa

SEQ ID NO: 162370 - DNA, 939 bp, Homo sapiens; identical to SEQ ID NO: 162369
  Payload ID: 11882
  Gene Symbol: OR51B2
  Gene Name: olfactory receptor, family 51, subfamily B, member 2 (gene/pseudogene)
  Uniprot ID: Q9Y5P1
  ENST ID: ENST00000624187
  CDS Start-End: 1-939

SEQ ID NO: 162371 - DNA, 1042 bp, Homo sapiens
  Payload ID: 11882
  Gene Symbol: OR51B2
  Gene Name: olfactory receptor, family 51, subfamily B, member 2 (gene/pseudogene)
  Uniprot ID: Q9Y5P1
  ENST ID: ENST00000624064
  CDS Start-End: 56-994
ggaggctcctggtttcaaggtttcaagaaatctgatctttaccggtggatacactatgtggcccaatattactgcagccccttttttgctgactggctttccagggctggaggcagctcatcactggatctccatccccttctttgctgtttatgtgtgcatccttctgggcaatggcatgctcctctacctcatcaagcatgaccacagtcttcatgagcccatgtactacttcctcaccatgctggcaggcacagacctcatggtgacattgaccacgatgcctactgtaatgggcatcctatgggtgaatcacagggagattagcagtgtgggctgcttcctacaggcttactttattcactccctttctgttgtggaatcaggttccctcctggcaatggcatatgattgtttcattgccatccgcaatcctttgagatatgcttccattctcaccaatactagagtcatagcgttaggagtgggagtgtttctaaggggttttgtatccatcctgcctgtaattttgcgtcttttttcattttcatattgcaaatctcatgttatcacacgtgctttctgcctccaccaagaaatcatgagactggcttgtgctgacataactttcaatagactttaccctgtaattttgatctctttaacaatcttcctagactgtctgatcatcctcttctcctatattctaattcttaatactgtcataggcattgcttctggtgaagagagagccaaagccctcaatacctgtatctcccacattagttgtgttcttatcttctatgttacagtgatgggtttgacattcatttacagatttgggaagaatgtgccagaggttgtccacattatcatgagttacatctacttcctctttcctcctttaatgaaccctgtcatctacagcatcaaaaccaagcaaatacaatatggcattatccgccttttatctaaacataggtttagtagttaaactcggatctggagaatcagacacagacataaaaatgaagccagaatg

SEQ ID NO: 162372 - DNA, 983 bp, Homo sapiens
  Payload ID: 11883
  Gene Symbol: OR51B4
  Gene Name: olfactory receptor, family 51, subfamily B, member 4
  Uniprot ID: Q9Y5P0
  ENST ID: ENST00000380224
  CDS Start-End: 51-983
ttggaggtcatcacccctaaaaaatatcttctccacctgcaaaacctaccatgtggtataacaacagtgctggccccttcttgctgactggcttcttgggctcagaggcagttcactaccggatctctatgtccttctttgtcatctacttctccgtcctttttggaaatggcactcttcttgtcctcatttggaatgatcacagcctccatgagcccatgtactacttcctggctatgctggcagacacggaccttgggatgacattcactacaatgcccacagtcctgggtgtcctgctgctagaccagagggagattgcccatgctgcctgtttcacccaatccttcattcattcactggccattgtagaatcaggtatcttgcttgttttggcctatgactgtttcattgccatccgcacaccactgaggtacaactgcattcttaccaattcccgagtgatgaacataggactgggggtactgatgagaggttttatgtccattttgcccataattctttcactctactgctacccatattgtggttcccgtgccctcttgcacacattttgcctccatcaagatgtcataaaactcgcctgtgctgatatcacgtttaatcacatatatccaattattcagacttctttgactgtctttttagatgctctaatcatcatcttttcttatatactaatcctcaagacagtgatgggcattgcgtctggacaagaggaagctaaatctctcaacacttgtgtctcccatattagctgtgtcctagtatttcacatcactgtgatgggactgtcattcattcacaggtttgggaaacatgcacctcatgtggtccccattaccatgagctatgtccattttctctttcctccattcgtgaatcctatcatttatagcatcaagaccaagcagattcaaagaagcattattcgcctattttctgggcagagtagggcttga

SEQ ID NO: 162373 - DNA, 939 bp, Homo sapiens
  Payload ID: 11884
  Gene Symbol: OR51B5
  Gene Name: olfactory receptor, family 51, subfamily B, member 5
  Uniprot ID: Q9H339
  ENST ID: ENST00000300773
  CDS Start-End: 1-939
atgtcgtccagcggcagctcccatcccttcctattgactggttttccaggcttggaggaagctcatcactggatttccgtatttttcttgttcatgtatatatccatcctttttggcaatggcaccctccttcttctcattaaggaagatcacaatcttcatgagcccatgtacttctttctggccatgctggctgccacagacctggggctggccctgaccacaatgcccacggtgctgggagtcctctggctggatcacagggagattggaagtgcggcctgcttttcccaggcctactttatacactcactttcctttctcgagtctggcattctgcttgccatggcctatgaccgttttattgccatctgcaaccctcttagatatacctctgtacttactaatactcgagtagtgaagattgggctgggagttctgatgaggggatttgtatccgttgttcccccaatcaggcccctctatttttttctgtattgtcactcccatgttctttcacatgcattctgccttcaccaggatgtcattaaactcgcctgtgctgataccaccttcaaccgactgtacccagctgtgcttgtagtctttatatttgtgctggattatctgattatcttcatctcctatgtgttgatactcaagactgtcctgagcattgcctccagagaggagagggccaaggctctcattacctgtgtctcccatatctgctgtgtcctggttttttatgtcacagtgattggattgtctctgattcatcgttttggaaagcaggttccacatattgttcacctcattatgagctatgcctattttctgttccctccactaatgaatcctataacatatagtgtcaagaccaagcagattcagaatgccattcttcacctttttactacccatagaattggaacctga

SEQ ID NO: 162374 - DNA, 939 bp, Homo sapiens
  Payload ID: 11885
  Gene Symbol: OR51B6
  Gene Name: olfactory receptor, family 51, subfamily B, member 6
  Uniprot ID: Q9H340
  ENST ID: ENST00000380219
  CDS Start-End: 1-939
atggggctcaataagtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtactatttcttagctatgttggcagctacagacctcggagtgacattgaccacaatgcccacagtgctaggtgttctgtggttagatcacagggagattggccatggagcctgcttctctcaggcctattttatccatactctttctgtcatggagtcaggtgtcttgcttgccatggcttatgactgtttcattaccatccgcagccccttaagatatacctctatcctgaccaacacccaggtaatgaagattggtgtgcgggtattgacaagggctggtctgtccattatgccaatagttgttcgcctacactggtttccctactgtcgatcccatgtactctcccatgctttctgtctacaccaagatgtcatcaagctagcctgtgctgacatcaccttcaaccgtctctatccagttgtagttttatttgcaatggtcttgttggactttctcatcatctttttctcctacattttgattctcaagactgtcatgggcattggttctggaggagaaagggccaaggccctcaacacatgtgtctctcatatctgctgcatcctggtcttctatgtcactgtagtttgtctgacatttattcataggtttggaaagcatgttcctcatgtcgttcacatcacaatgagctacatccacttccttttcccaccttttatgaacccatttatctatagcattaaaactaagcagattcagagtggcatacttcgtttattctctctgcctcactctagagcatga

SEQ ID NO: 162375 - DNA, 1124 bp, Homo sapiens
  Payload ID: 11886
  Gene Symbol: OR51D1
  Gene Name: olfactory receptor, family 51, subfamily D, member 1
  Uniprot ID: Q8NGF3
  ENST ID: ENST00000357605
  CDS Start-End: 77-1051
cctttctctcctctgagccacaactaaatgatgtttctacttttccctttctactttcctagaccctggattttgtatgcagaagccccagctcttggtccctatcatagccacttcaaatggaaatctggtccacgcagcatacttccttttggtgggtatccctggcctggggcctaccatacacttttggctggctttcccactgtgttttatgtatgccttggccaccctgggtaacctgaccattgtcctcatcattcgtgtggagaggcgactgcatgagcccatgtacctcttcctggccatgctttccactattgacctagtcctctcctctatcaccatgcccaagatggccagtcttttcctgatgggcatccaggagatcgagttcaacatttgcctggcccagatgttccttatccatgctctgtcagccgtggagtcagctgtcctgctggccatggcttttgaccgctttgtggccatttgccacccattgcgccatgcttctgtgctgacagggtgtactgtggccaagattggactatctgccctgaccagggggtttgtattcttcttcccactgcccttcatcctcaagtggttgtcctactgccaaacacatactgtcacacactccttctgtctgcaccaagatattatgaagctgtcctgtactgacaccagggtcaatgtggtttatggactcttcatcatcctctcagtcatgggtgtggactctctcttcattggcttctcatatatcctcatcctgtgggctgttttggagctgtcctctcggagggcagcactcaaggctttcaacacctgcatctcccacctctgtgctgttctggtcttctatgtacccctcattgggctctcggtggtgcataggctgggtggtcccacctccctcctccatgtggttatggctaatacctacttgctgctaccacctgtagtcaacccccttgtctatggagccaagaccaaagagatctgttcaagggtcctctgtatgttctcacaaggtggcaagtgagacaccttagtgtctcgcttctactactactacagaagatgggaatattaggatcctattgaatgccttggtg

SEQ ID NO: 162376 - DNA, 3612 bp, Homo sapiens
  Payload ID: 11887
  Gene Symbol: OR51E1
  Gene Name: olfactory receptor, family 51, subfamily E, member 1
  Uniprot ID: Q8TCB6
  ENST ID: ENST00000396952
  CDS Start-End: 651-1607
aattccacgcttagcaaggacctaaacagtgtcccccaaatgagagaagggaggacagaaagaacacttcaggatggaaatgggctgacacttaaccgtggagtgtctctgcaaacttcctttgccattctcctgtttgagtttgataaacctgagaagagacttggataaagaccgtcacgaagactacactaatgagtttcttctagcttttttctactcactttccctatctatccttcacattgggagttggcatgaggatcccagcagcccatcaggggaggactctagagatccctttccccattgcctctcctccccatacccccaggcatatcctcccagggcacggaagctgagaagcagtccagaaccacagtgggctagtgaggggtacctgctgatgtaccctttggacagcattctgccccaccctgcaggaagaagcagaaggagggagagggtgaggcagagaataaataaccctgaccagggaggtccaagggagtaggcggagacagagaggctgtatttcagtgcagcctgccagacctcttctggaggaagactggacaaagggggtcacacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagtttgatgcttgtctgctacagatgtttgccatccactccttatctggcatggaatccacagtgctgctggccatggcttttgaccgctatgtggccatctgtcacccactgcgccatgccacagtacttacgttgcctcgtgtcaccaaaattggtgtggctgctgtggtgcggggggctgcactgatggcaccccttcctgtcttcatcaagcagctgcccttctgccgctccaatatcctttcccattcctactgcctacaccaagatgtcatgaagctggcctgtgatgatatccgggtcaatgtcgtctatggccttatcgtcatcatctccgccattggcctggactcacttctcatctccttctcatatctgcttattcttaagactgtgttgggcttgacacgtgaagcccaggccaaggcatttggcacttgcgtctctcatgtgtgtgctgtgttcatattctatgtacctttcattggattgtccatggtgcatcgctttagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagccctaggtgtcagtgatcaaacttcttttccattcagagtcctctgattcagattttaatgttaacattttggaagacagtattcagaaaaaaaatttccttaataaaaatacaactcagatccttcaaatatgaaactggttggggaatctccattttttcaatattattttcttctttgttttcttgctacatataattattaataccctgactaggttgtggttggagggttattacttttcattttaccatgcagtccaaatctaaactgcttctactgatggtttacagcattctgagataagaatggtacatctagagaacatttgccaaaggcctaagcacggcaaaggaaaataaacacagaatataataaaatgagataatctagcttaaaactataacttcctcttcagaactcccaaccacattggatctcagaaaaatgctgtcttcaaaatgacttctacagagaagaaataatttttcctctggacactagcacttaaggggaagattggaagtaaagccttgaaaagagtacatttacctacgttaatgaaagttgacacactgttctgagagttttcacagcatatggaccctgtttttcctatttaattttcttatcaaccctttaattaggcaaagatattattagtaccctcattgtagccatgggaaaattgatgttcagtggggatcagtgaattaaatggggtcatacaagtataaaaattaaaaaaaaaagacttcatgcccaatctcatatgatgtggaagaactgttagagagaccaacagggtagtgggttagagatttccagagtcttacattttctagaggaggtatttaatttcttctcactcatccagtgttgtatttaggaatttcctggcaacagaactcatggctttaatcccactagctattgcttattgtcctggtccaattgccaattacctgtgtcttggaagaagtgatttctaggttcaccattatggaagattcttattcagaaagtctgcatagggcttatagcaagttatttatttttaaaagttccataggtgattctgataggcagtgaggttagggagccaccagttatgatgggaagtatggaatggcaggtcttgaagataacattggccttttgagtgtgactcgtagctggaaagtgagggaatcttcaggaccatgctttatttggggctttgtgcagtatggaacagggactttgagaccaggaaagcaatctgacttaggcatgggaatcaggcatttttgcttctgaggggctattaccaagggttaataggtttcatcttcaacaggatatgacaacagtgttaaccaagaaactcaaattacaaatactaaaacatgtgatcatatatgtggtaagtttcattttctttttcaatcctcaggttccctgatatggattcctataacatgctttcatccccttttgtaatggatatcatatttggaaatgcctatttaatacttgtatttgctgctggactgtaagcccatgagggcactgtttattattgaatgtcatctctgttcatcattgactgctctttgctcatcattgaatcccccagcaaagtgcctagaacataatagtgcttatgcttgacaccggttatttttcatcaaacctgattccttctgtcctgaacacatagccaggcaattttccagccttctttgagttgggtattattaaattctggccattacttccaatgtgagtggaagtgacatgtgcaatttctatacctggctcataaaaccctcccatgtgcagcctttcatgttgacattaaatgtgacttgggaagctatgtgttacacagagtaaatcaccagaagcctggatttctgaaaaaactgtgcagagccaaacctctgtcatttgcaactcccacttgtatttgtacgaggcagttggataagtgaaaaataaagtactattgtgtcaagtctctgaaaa

SEQ ID NO: 162377 - DNA, 455 bp, Homo sapiens
  Payload ID: 11887
  Gene Symbol: OR51E1
  Gene Name: olfactory receptor, family 51, subfamily E, member 1
  ENST ID: ENST00000530215
  CDS Start-End: 42-260
agcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagccctaggtgtcagtgatcaaacttcttttccattcagagtcctctgattcagattttaatgttaacattttggaagacagtattcagaaaaaaaatttccttaataaaaatacaactcagatccttcaaatat

SEQ ID NO: 162378 - DNA, 2781 bp, Homo sapiens
  Payload ID: 11888
  Gene Symbol: OR51E2
  Gene Name: olfactory receptor, family 51, subfamily E, member 2
  Uniprot ID: Q9H255
  ENST ID: ENST00000396950
  CDS Start-End: 241-1203
ctccacaccctgaagacacagtgagttagcaccaccaccaggaattggcctttcagctctgtgcctgtctccagtcaggctggaataagtctcctcatatttgcaagctcggccctcccctggaatctaaagcctcctcagccttctgagtcagcctgaaaggaacaggccgaactgctgtatgggctctactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagtggtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtgacccttaacactacacttctccttatctttattggcttgataaacataattatttctaacactagcttatttccagttgcccataagcacatcagtacttttctctggctggaatagtaaactaaagtatggtacatctacctaaaggactattatgtggaataatacatactaatgaagtattacatgatttaaagactacaataaaaccaaacatgcttataacattaagaaaaacaataaagatacatgattgaaaccaagttgaaaaatagcatatgccttggaggaaatgtgctcaaattactaatgatttagtgttgtccctactttctctctcttttttctttcttttttttttattatggttagctgtcacatacaactttttttttttttgagatggggtctcgctctgtcaccaggctggagtgcagtggcgcgatctcggctcactgcaacctccacatcccatgttgaagtaattcttctgcctcagcctcccgagtagctgggactagaggaacgtgccaccatgactggctaattttctgtattttttagtagagacagagtttcaccatgttggccaggatggtctcgatctcctgaccttgtgatccacccgcctcagcctcccaaagtgttgggattacaggtgtgaaccactgtgcccggcctgtgtacaactttttaaatagggaatatgatagcttcgcatggtggtgtgcacctatagcccccactgcctggaaagctgaggtgggagaatcgcttgagtccaggagtttgaggttacagtgatccacgatcgtaccactacactccagcctgggcaacagagcaagaccctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggactaaagtcacacggcttgtgggcactgtgccaagatttaaaattaaatttgatggttgaatacagttacttaatgaccatgttatattgcttcctgtgtaacatctgccatttatttcctcagctgtacaaatcctctgttttctctctgttacacactaacatcaatggctttgtacttgtgatgagagataaccttgccctagttgtgggcaacacatgcagaataatcctgttttacagctgcctttcgtgatcttattgcttgcttttttccagattcagggagaatgttgttgtctatttgtctcttacatctccttgatcatgtcttcattttttaatgtgctctgtacctgtcaaaaattttgaatgtacaccacatgctattgtctgaacttgagtataagataaaataaaattttattttaaatttt

SEQ ID NO: 162379 - DNA, 582 bp, Homo sapiens
  Payload ID: 11888
  Gene Symbol: OR51E2
  Gene Name: olfactory receptor, family 51, subfamily E, member 2
  ENST ID: ENST00000532598
  CDS Start-End: 332-582
tcttctgggaatctccacaccctgaagacacagtgagttagcaccaccaccaggaattggcctttcagctctgtgcctgtctccagtcaggctggaataagtctcctcatatttgcaagctcggccctcccctggaatctaaagcctcctcagccttctgagtcagcctgaaaggaacaggccgaactgctgtatgggctctgggacacgtcactggaagacagccatcaagcatcatgaggtactgaggatacctcaatatcctggagaaggtagttgggactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgccctttt

SEQ ID NO: 162380 - DNA, 939 bp, Homo sapiens; identical to SEQ ID NO: 161888
  Payload ID: 11889
  Gene Symbol: OR51F1
  Gene Name: olfactory receptor, family 51, subfamily F, member 1 (gene/pseudogene)
  ENST ID: ENST00000343430
  CDS Start-End: 1-939

SEQ ID NO: 162381 - DNA, 1029 bp, Homo sapiens
  Payload ID: 11890
  Gene Symbol: OR51F2
  Gene Name: olfactory receptor, family 51, subfamily F, member 2
  Uniprot ID: Q8NH61
  ENST ID: ENST00000322110
  CDS Start-End: 1-1029
atgactgaaacatccctgtcttctcagtgcttccctatgtcggtcctcaataataccattgctgagcctctgatcttcctcctgatgggcattccaggcctgaaagccacccagtactggatctccatccctttttgtctcctatatgttgttgccgtctctggaaatagcatgatcctgtttgtggtcctctgtgaacggagcctccataagcctatgtactatttcctctctatgctttcagccacagacctgagcttgtccctgtgtacactttctactacccttggtgtcttctggtttgaagcccgagaaatcaacctaaatgcctgcattgcccagatgttctttctacacggatttactttcatggagtctggggttctactggccatggcctttgatcgttttgtggccatctgttacccactgagatacactaccatccttaccaatgcccgaattgccaagattgggatgagcatgttgataagaaatgttgccgtcatgttgccagtcatgctctttgtcaagaggttgtccttctgcagttctatggtcctttcacattcttactgctaccatgttgatctcatccaactctcctgcacagacaataggatcaacagcatccttggtctgtttgcgcttttgtccactacagggtttgactgcccttgcatcctgctctcctatatcctgatcattcgatctgtcctcagcattgcttcctcagaagagaggcggaaagccttcaacacctgcacatcccacatcagtgctgtttccatcttctacctccctctcatcagtttgtctcttgtccatcgctatggccattcagcacctccatttgtccacatcatcatggccaatgtctttctgctaatccctcctgtgctcaaccctattatttacagtgtaaagattaagcagattcaaaaggccattatcaaggtcttaattcagaagcactccaaatctaatcatcagctatttctgattagagataaagccatttatgaataa

SEQ ID NO: 162382 - DNA, 966 bp, Homo sapiens
  Payload ID: 11891
  Gene Symbol: OR51G1
  Gene Name: olfactory receptor, family 51, subfamily G, member 1 (gene/pseudogene)
  Uniprot ID: Q8NGK1
  ENST ID: ENST00000321961
  CDS Start-End: 1-966
atgacaattcttcttaatagcagcctccaaagagccactttcttcctgacgggcttccaaggtctagaaggtctccatggctggatctctattcccttctgcttcatctacctgacagttatcttggggaacctcaccattctccacgtcatttgtactgatgccactctccatggacccatgtactatttcttgggcatgctagctgtcacagacttaggcctttgcctttccacactgcccactgtgctgggcattttctggtttgataccagagagattggcatccctgcctgtttcactcagctcttcttcatccacaccttgtcttcaatggagtcatcagttctgttatccatgtccattgaccgctacgtggccgtctgcaacccactgcatgactccaccgtcctgacacctgcatgtattgtcaagatggggctaagctcagtgcttagaagtgctctcctcatcctccccttgccattcctcctgaagcgcttccaatactgccactcccatgtgctggctcatgcttattgtcttcacctggagatcatgaagctggcctgctctagcatcattgtcaatcacatctatgggctctttgttgtggcctgcaccgtgggtgtggactccctgctcatctttctctcatacgccctcatccttcgcaccgtgctcagcattgcctcccaccaggagcgactccgagccctcaacacctgtgtctctcatatctgtgctgtactgctcttctacatccccatgattggcttgtctcttgtgcatcgctttggtgaacatctgccccgcgttgtacacctcttcatgtcctatgtgtatctgctggtaccaccccttatgaaccccatcatctacagcatcaagaccaagcaaattcgccagcgcatcattaagaagtttcagtttataaagtcacttaggtgtttttggaaggattaa

SEQ ID NO: 162383 - DNA, 945 bp, Homo sapiens
  Payload ID: 11892
  Gene Symbol: OR51G2
  Gene Name: olfactory receptor, family 51, subfamily G, member 2
  Uniprot ID: Q8NGK0
  ENST ID: ENST00000322013
  CDS Start-End: 1-945
atgaccctgggatccctgggaaacagcagcagcagcgtttctgctaccttcctgctgagtggcatccctgggctggagcgcatgcacatctggatctccatcccactgtgcttcatgtatctggtttccatcccgggcaactgcacaattctttttatcattaaaacagagcgctcacttcatgaacctatgtatctcttcctgtccatgctggctctgattgacctgggtctctccctttgcactctccctacagtcctgggcatcttttgggttggagcacgagaaattagccatgatgcctgctttgctcagctctttttcattcactgcttctccttcctcgagtcctctgtgctactgtctatggcctttgaccgctttgtggctatctgccaccccttgcactatgtttccattctcaccaacacagtcattggcaggattggcctggtctctctgggtcgtagtgtagcactcatttttccattaccttttatgctcaaaagattcccctattgtggctccccagttctctcacattcttattgtctccaccaagaagtgatgaaattggcctgtgccgacatgaaggccaacagcatctacggcatgtttgtcatcgtctctacagtgggtatagactcactgctcatcctcttctcttatgctctgatcctgcgcaccgtgctgtccatcgcctccagggctgagagattcaaggcccttaacacctgtgtttcccacatctgtgctgtgctgctcttctacactcccatgattggcctctctgtcatccatcgctttggaaagcaggcaccccacctggtccaggtggtcatgggtttcatgtatcttctctttcctcctgtgatgaatcccattgtctacagtgtgaagaccaaacagatccgggatcgagtgacgcatgccttttgttactaa

SEQ ID NO: 162384 - DNA, 909 bp, Homo sapiens
  Payload ID: 11893
  Gene Symbol: OR51H1
  Gene Name: olfactory receptor, family 51, subfamily H, member 1
  Uniprot ID: Q8NH63
  ENST ID: ENST00000322059
  CDS Start-End: 1-909
atgacgaacttgaatgcatcacaggccaaccaccgtaacttcattctgacaggtatcccaggaacgccagacaagaacccatggttggcctttcccctgggatttctctacacactcacactcctgggaaatggtaccatcctagctgtcatcaaggtggagccaagtctccatgagcccacgtattacttcctttctatcttggctctcactgacgttagtctctccatgtccaccttgccctccatgctcagcatctactggtttaatgcccctcagattgtttttgatgcatgcatcatgcagatgttcttcatccatgtatttggaatagtagaatcaggagtcctagtgtccatggcctttgacagatttgtggccatccgaaacccattacactatgtttccatcctcactcacgatgttattcgaaagactggaatagctgtcctcacccgggcagtctgtgtggtattccctgtgcccttccttataaagtgcctacccttctgccattccaatgtcttgtctcattcatactgtcttcaccaaaacatgatgcggctagcttgtgccagcacccgcatcaacagcctctacggcctcatcgtcgtcatcttcacactggggctcgatgttctcctcactctactgtcttatgtactcaccctgaagactgtgctgggcattgtctccagaggtgaaaggctgaaaaccctcagcacatgcctctctcacatgtctaccgtgctcctcttctatgttccttttatgggtgctgcctccatgatccacagattttgggagcatttatcaccagtagtgcacatggtcatggctgatatatacctactgctcccgcctgtgctaaaccccattgtctacagtgtgaagaccaagcaaatttga

SEQ ID NO: 162385 - DNA, 945 bp, Homo sapiens
  Payload ID: 11894
  Gene Symbol: OR51I1
  Gene Name: olfactory receptor, family 51, subfamily I, member 1
  Uniprot ID: Q9H343
  ENST ID: ENST00000380211
  CDS Start-End: 1-945
atgctgggtctcaatggcacccccttccagccagcaacactccagctgacaggcattcctgggatacaaacaggcctcacctgggttgccctgattttctgcatcctctacatgatctccattgtaggtaacctcagcattctcactctggtgttttgggagcctgctctgcatcagcccatgtactacttcctctctatgctcgctctcaatgatctgggagtgtccttttctacacttcccactgtgatttctactttctgcttcaactacaaccatgttgcgtttaatgcttgcctggtccagatgttcttcatccacactttctccttcatggagtcaggcatactgctggccatgagcttggatcgctttgtggctatttgttatccattacgctatgtcactgtgctcactcacaaccgtatattggctatgggtctgggcatccttaccaagagtttcaccactctcttccctttcccttttgtggtgaaacgactgcccttctgcaaaggcaatgttttgcatcactcctactgtctccatccagatctcatgaaagtagcatgtggagacatccatgttaacaacatttatgggctcttggtgatcatttttacctatggtatggactcaactttcatcctgctttcctacgcattgatcctgagagccatgctggtcatcatatcccaggaacagcggctcaaggcactcaacacctgcatgtcacacatctgtgcagtgctggccttttatgtgcccataattgctgtctccatgattcaccgcttctggaaaagtgctccacctgttgttcatgtcatgatgtccaatgtctacctgtttgtaccacccatgctcaaccctatcatctacagtgtgaaaaccaaggagatccgcaaagggattctcaagttcttccataaatcccaggcctga

SEQ ID NO: 162386 - DNA, 939 bp, Homo sapiens
  Payload ID: 11895
  Gene Symbol: OR51I2
  Gene Name: olfactory receptor, family 51, subfamily I, member 2
  Uniprot ID: Q9H344
  ENST ID: ENST00000341449
  CDS Start-End: 1-939
atggggttgttcaatgtcactcaccctgcattcttcctcctgactggtatccctggtctggagagctctcactcctggctgtcagggcccctctgcgtgatgtatgctgtggcccttgggggaaatacagtgatcctgcaggctgtgcgagtggagcccagcctccatgagcccatgtactacttcctgtccatgttgtccttcagtgatgtggccatatccatggccacactgcccactgtactccgaaccttctgcctcaatgcccgcaacatcacttttgatgcctgtctaattcagatgtttcttattcacttcttctccatgatggaatcaggtattctgctggccatgagttttgaccgctatgtggccatttgtgaccccttgcgctatgcaactgtgctcaccactgaagtcattgctgcaatgggtttaggtgcagctgctcgaagcttcatcacccttttccctcttccctttcttattaagaggctgcctatctgcagatccaatgttctttctcactcctactgcctgcacccagacatgatgaggcttgcctgtgctgatatcagtatcaacagcatctatggactctttgttcttgtatccacctttggcatggacctgttttttatcttcctctcctatgtgctcattctgcgttctgtcatggccactgcttcccgtgaggaacgcctcaaagctctcaacacatgtgtgtcacatatcctggctgtacttgcattttatgtgccaatgattggggtctccacagtgcaccgctttgggaagcatgtcccatgctacatacatgtcctcatgtcaaatgtgtacctatttgtgcctcctgtgctcaaccctctcatttatagcgccaagacaaaggaaatccgccgagccattttccgcatgtttcaccacatcaaaatatga

SEQ ID NO: 162387 - DNA, 951 bp, Homo sapiens
  Payload ID: 11896
  Gene Symbol: OR51J1
  Gene Name: olfactory receptor, family 51, subfamily J, member 1 (gene/pseudogene)
  Uniprot ID: Q9H342
  ENST ID: ENST00000332043
  CDS Start-End: 1-951
atgaaaatttctaataactctttggggtttttacctacgactttcattttggttggcatcccagggctggagtcagagcacctctggatatccgtccccttctccctgatatacatcatcattttccttgggaatggcatcattcttcacgtcatcagaacagatattgccctacatcaacccatgtacctcttccttgccatgttggcactggccgaggttcgtgtctctgcatccaccctgcctacagtgttaggcatattcctttttggaaatactgaaattagtcttgaagcttgtctttttccagatgttctccatccattctttatccatgatggagccagctgtgctgctggccatgtctttggaccgctttatagccatctacagcccactgagctacacagctatcctgacactgcccagggtctttggcacaggagctattatcgtactgaaaagcattatgctcatggctccgttgcccattctcttatggcgtctgcccttctgtggccacaatgccctctcacattcctattgtctgcaccccaatcttatctatcttgtgggaacatttctgttaacaatatctatgggattttcattgttacctctacttttgggctggattcgttgctgattgtgatctcctatgggctcatactccacactgtattgggtattgccactggagaagggaggaagaaggcactcaacacatgtggctcacacgtctgtgctgtgcttgcttactatgtgcctatgattggcttgtctatagtgcaccgccttggacatcgtgtgtcccctctgctgcaagccatgatggccaatgcctacctcttcttcccacctgttgtcaatcctattgtctacagcattaagaccaaggagatccatggtgccattgtccgaatgctattagagaaaagacgcagagtgtag

SEQ ID NO: 162388 - DNA, 948 bp, Homo sapiens
  Payload ID: 11897
  Gene Symbol: OR51L1
  Gene Name: olfactory receptor, family 51, subfamily L, member 1
  Uniprot ID: Q8NGJ5
  ENST ID: ENST00000321543
  CDS Start-End: 1-948
atgggagactggaataacagtgatgctgtggagcccatatttatcctgaggggttttcctggactggagtatgttcattcttggctctccatcctcttctgtcttgcatatttggtagcatttatgggtaatgttaccatcctgtctgtcatttggatagaatcctctctccatcagcccatgtattactttatttccatcttagcagtgaatgacctggggatgtccctgtctacacttcccaccatgcttgctgtgttatggttggatgctccagagatccaggcaagtgcttgctatgctcagctgttcttcatccacacattcacattcctggagtcctcagtgttgctggccatggcctttgaccgttttgttgctatctgccatccactgcactaccccaccatcctcaccaacagtgtaattggcaaaattggtttggcctgtttgctacgaagcttgggagttgtacttcccacacctttgctactgagacactatcactactgccatggcaatgccctctctcacgccttctgtttgcaccaggatgttctaagattatcctgtacagatgccaggaccaacagtatttatgggctttgtgtagtcattgccacactaggtgtggattcaatcttcatacttctttcttatgttctgattcttaatactgtgctggatattgcatctcgtgaagagcagctaaaggcactcaacacatgtgtatcccatatctgtgtggtgcttatcttctttgtgccagttattggggtgtcaatggtccatcgctttgggaagcatctgtctcccatagtccacatcctcatggcagacatctaccttcttcttcccccagtccttaaccctattgtctatagtgtcagaacaaagcagattcgtctaggaattctccacaagtttgtcctaaggaggaggttttaa

SEQ ID NO: 162389 - DNA, 981 bp, Homo sapiens
  Payload ID: 11898
  Gene Symbol: OR51M1
  Gene Name: olfactory receptor, family 51, subfamily M, member 1
  Uniprot ID: Q9H341
  ENST ID: ENST00000328611
  CDS Start-End: 1-981
atgtcagtccaatattcgctcagtcctcaattcatgctgctatccaacattactcagtttagccccatattctatctcaccagctttcctggattggaaggcatcaaacactggattttcatcccctttttctttatgtacatggttgccatctcaggcaattgtttcattctgatcattattaagaccaaccctcgtctgcacacacccatgtactatctactatccttgctggccctcactgacctggggctgtgtgtgtccacgttgcccaccactatggggatcttctggtttaactcccatagtatctactttggagcgtgtcaaatccagatgttctgcatccactctttttccttcatggagtcctcagtgctcctcatgatgtcctttgaccgccttgtggccatctgccaccctctgaggtattcggtcattatcactggccagcaagtggtcagagcaggcctaattgtcatcttccggggacctgtggccactatccctattgtcctcctcctgaaggcttttccctactgtggatctgtggtcctctcccactcattttgcctgcaccaggaagtgatacagctggcctgcacagatatcaccttcaataatctgtatggactgatggtggtagttttcactgtgatgctggacctggtgctcatcgcactgtcctatggactcatcctgcacacagtagcaggcctggcctcccaagaggagcagcgccgtgcctttcagacatgcaccgctcctctctgtgctgtgctagtattctttgtgcccatgatggggctgtccctggtgcaccgttttgggaagcatgccccacctgctattcatcttcttatggccaatgtctacctttttgtgcctcccatgcttaacccaatcatatacagcattaagaccaaggagatccaccgtgccattatcaagttcctaggtcttaaaaaggccagtaaatga

SEQ ID NO: 162390 - DNA, 1096 bp, Homo sapiens
  Payload ID: 11899
  Gene Symbol: OR51Q1
  Gene Name: olfactory receptor, family 51, subfamily Q, member 1 (gene/pseudogene)
  Uniprot ID: Q8NH59
  ENST ID: ENST00000300778
  CDS Start-End: 91-1044
ttggattaaatggggcaaagagatattatttctaatgtttctttttctccctgagtgaagatcctgaatctgaagacacattcatcagtcatgtcccaggtgactaacaccacacaagaaggcatctacttcatcctcacggacatccctggatttgaggcctcccacatctggatctccatccccgtctgctgtctctacaccatctccatcatgggcaataccaccatcctcactgtcattcgcacagagccatctgtccaccagcgcatgtatctgtttctctccatgctggccctgacggacctgggtctcaccctcaccaccctacccacagtcatgcagcttctctggttcaacgttcgtagaatcagctctgaggcctgttttgctcagtttttcttccttcatggattctcctttatggagtcttctgtcctcctggctatgtccgttgactgctatgtggccatctgctgtcccctccattatgcctccatcctcaccaatgaagtcattggtagaactgggttagccatcatttgctgctgtgttctggcggttcttccctcccttttcttactcaagcgactgcctttctgccactcccaccttctctctcgctcctattgcctccaccaggatatgatccgcctggtctgtgctgacatcaggctcaacagctggtatggatttgctcttgccttgctcattattatcgtggatcctctgctcattgtgatctcctatacacttattctgaaaaatatcttgggcacagccacctgggctgagcgactccgtgccctcaataactgcctgtcccacattctagctgtcctggtcctctacattcccatggttggtgtatctatgactcatcgctttgccaagcatgcctctccactggtccatgttatcatggccaatatctacctgctggcacccccggtgatgaaccccatcatttacagtgtaaagaacaagcagatccaatggggaatgttaaatttcctttccctcaaaaatatgcattcaagatgagggaatgcatttcttaaattactgacaagtatgagtcataggcttaaggggg

SEQ ID NO: 162391 - DNA, 972 bp, Homo sapiens
  Payload ID: 11900
  Gene Symbol: OR51S1
  Gene Name: olfactory receptor, family 51, subfamily S, member 1
  Uniprot ID: Q8NGJ8
  ENST ID: ENST00000322101
  CDS Start-End: 1-972
atgtcaacattaccaactcagatagcccccaatagcagcacttcaatggcccccaccttcttgctggtgggcatgccaggcctatcaggtgcaccctcctggtggacattgcccctcattgctgtctaccttctctctgcactgggaaatggcaccatcctctggatcattgccctgcagcccgccctgcaccgcccaatgcacttcttcctcttcttgcttagtgtgtctgatattggattggtcactgccctgatgcccacactgctgggcatcgcccttgctggtgctcacactgtccctgcctcagcctgccttctacagatggtttttatccatgtcttttctgtcatggagtcctctgtcttgctcgccatgtccattgatcgggcactggccatctgccgacctctccactacccagcgctcctcaccaatggtgtaattagcaaaatcagcctggccatttcttttcgatgcctgggtctccatctgcccctgccattcctgctggcctacatgccctactgcctcccacaggtcctaacccattcttattgcttgcatccagatgtggctcgtttggcctgcccagaagcttggggtgcagcctacagcctatttgtggttctttcagccatgggtttggaccccctgcttattttcttctcctatggcctgattggcaaggtgttgcaaggtgtggagtccagagaggatcgctggaaggctggtcaaacctgtgctgcccacctctctgcagtgctcctcttctatatccctatgatcctcctggcactgattaaccatcctgagctgccaatcactcagcatacccatactcttctatcctatgtccatttccttcttcctccattgataaaccctattctctatagtgtcaagatgaaggagattagaaagagaatactcaacaggttgcagcccaggaaggtgggtggtgctcagtga

SEQ ID NO: 162392 - DNA, 984 bp, Homo sapiens
  Payload ID: 11901
  Gene Symbol: OR51T1
  Gene Name: olfactory receptor, family 51, subfamily T, member 1
  Uniprot ID: Q8NGJ9
  ENST ID: ENST00000322049
  CDS Start-End: 1-984
atggcaatattcaataacaccacttcgtcttcctcaaacttcctcctcactgcattccctgggctggaatgtgctcatgtctggatctccattccagtctgctgtctctacaccattgccctcttgggaaacagtatgatctttcttgtcatcattactaagcggagactccacaaacccatgtattatttcctctccatgctggcagctgttgatctatgtctgaccattacgacccttcccactgtgcttggtgttctctggtttcatgcccgggagatcagctttaaagcttgcttcattcaaatgttctttgtgcatgctttctccttgctggagtcctcggtgctggtagccatggcctttgaccgcttcgtggctatctgtaacccactgaactatgctactatcctcacagacaggatggtcctggtgatagggctggtcatctgcattagaccagcagttttcttacttccccttcttgtagccataaacactgtgtcttttcatgggggtcacgagctttcccatccattttgctaccacccagaagtgatcaaatacacatattccaaaccttggatcagcagtttttggggactgtttcttcagctctacctgaatggcactgacgtattgtttattcttttctcctatgtcctgatcctccgtactgttctgggcattgtggcccgaaagaagcaacaaaaagctctcagcacttgtgtctgtcacatctgtgcagtcactattttctatgtgccactgatcagcctctctttggcacaccgcctcttccactccaccccaagggtgctctgtagcactttggccaatatttatctgctcttaccacctgtgctgaaccctatcatttacagcttgaagaccaagacaatccgccaggctatgttccagctgctccaatccaagggttcatggggttttaatgtgaggggtcttaggggaagatgggattga

SEQ ID NO: 162393 - DNA, 1065 bp, Homo sapiens
  Payload ID: 11901
  Gene Symbol: OR51T1
  Gene Name: olfactory receptor, family 51, subfamily T, member 1
  ENST ID: ENST00000380378
  CDS Start-End: 1-1065
atgactaataaaatgtatgctatatatataaagaatcttaattatttttctttcctcatagttcagtgtcttcaaccaaccatggcaatattcaataacaccacttcgtcttcctcaaacttcctcctcactgcattccctgggctggaatgtgctcatgtctggatctccattccagtctgctgtctctacaccattgccctcttgggaaacagtatgatctttcttgtcatcattactaagcggagactccacaaacccatgtattatttcctctccatgctggcagctgttgatctatgtctgaccattacgacccttcccactgtgcttggtgttctctggtttcatgcccgggagatcagctttaaagcttgcttcattcaaatgttctttgtgcatgctttctccttgctggagtcctcggtgctggtagccatggcctttgaccgcttcgtggctatctgtaacccactgaactatgctactatcctcacagacaggatggtcctggtgatagggctggtcatctgcattagaccagcagttttcttacttccccttcttgtagccataaacactgtgtcttttcatgggggtcacgagctttcccatccattttgctaccacccagaagtgatcaaatacacatattccaaaccttggatcagcagtttttggggactgtttcttcagctctacctgaatggcactgacgtattgtttattcttttctcctatgtcctgatcctccgtactgttctgggcattgtggcccgaaagaagcaacaaaaagctctcagcacttgtgtctgtcacatctgtgcagtcactattttctatgtgccactgatcagcctctctttggcacaccgcctcttccactccaccccaagggtgctctgtagcactttggccaatatttatctgctcttaccacctgtgctgaaccctatcatttacagcttgaagaccaagacaatccgccaggctatgttccagctgctccaatccaagggttcatggggttttaatgtgaggggtcttaggggaagatgggattga

SEQ ID NO: 162394 - DNA, 966 bp, Homo sapiens
  Payload ID: 11902
  Gene Symbol: OR51V1
  Gene Name: olfactory receptor, family 51, subfamily V, member 1
  Uniprot ID: Q9H2C8
  ENST ID: ENST00000321255
  CDS Start-End: 1-966
atgtttctcagttccagaatgattacttcagtaagccctagcaccagcacgaattcttcctttcttctcactggattttctggcatggagcagcaatacccctggctttccatccccttctcctcaatctatgccatggtgcttttgggcaattgcatggttctccatgtgatatggactgagccaagcctgcaccagcctatgttttacttcctgtccatgctggccctcactgacctgtgcatggggctgtccactgtgtacacagtgctggggatcctgtgggggatcattcgagagatcagcttggattcctgcattgcccagtcctatttcatccatggtctgtccttcatggagtcctctgtcctcctcactatggcctttgaccggtacattgcaatttgcaatccactacgttattcctccatcctgactaattccagaattatcaaaattgggctcactataataggtaggagttttttctttattacaccccccatcatctgtctgaaattttttaattactgtcatttccacatcctttctcactctttctgcctgcaccaggatcttctccgcttagcctgttcagacatccgattcaatagttactatgccctgatgctggttatttgcatactgttgttggatgctatactcatccttttctcctacatcctgattcttaagtcagtcctggcagttgcctctcaggaagagaggcataaattatttcagacctgcatctcccacatctgtgctgtccttgtgttctacatccctatcattagcctcacaatggtgcaccgttttggcaagcacctttcccccgtggcccacgttctcattggcaacatctacatccttttcccacctttaatgaatcccatcatctacagtgtcaagacccaacagattcataccagaatgcttagactcttttctctgaaaagatattga

SEQ ID NO: 162395 - DNA, 939 bp, Homo sapiens
  Payload ID: 11903
  Gene Symbol: OR52A1
  Gene Name: olfactory receptor, family 52, subfamily A, member 1
  Uniprot ID: Q9UKL2
  ENST ID: ENST00000328942
  CDS Start-End: 1-939
atgtccatttccaacatcacagtctacatgccctctgtgttgacactagtagggatcccaggcctagaatctgtgcagtgctggattgggattccattctgtgccatttatctcattgctatgattggaaattccttgcttctgagcatcatcaaatctgagcgcagtctccatgagcccttgtacattttcttaggcatgctaggagccacagacattgcacttgctagcagcattatgccaaagatgcttggaatattctggtttaatgtgcctgaaatctattttgattcctgcttgcttcaaatgtggttcatccacacattgcagggtatagagtcaggcatccttgtggccatggccctggaccgttatgtggccatctgttatccactaagacatgccaacatcttcacccaccagcttgtcattcagataggaactatggtcgtactcagggctgctattcttgtagccccatgcctagtactgataaagtgccggtttcaattttatcacacaacagtcatctcccactcctactgtgagcatatggccattgtgaaactagcagcagcaaatgttcaagtcaacaaaatctatggtttgtttgtggccttcactgtagcaggatttgacctcacattcatcacattgtcctacatccagatatttatcacagtttttcgtttgccccagaaggaggctaggtttaaagcattcaatacctgcattgctcacatctgtgtcttcctccagttctacctccttgccttcttctccttcttcacacataggtttgggtctcacatctccccttatatccatattctcttttctagcatttacttgctggtccctccatttctcaatccacttgtctatggtgcaaagaccacacagattcgcattcatgtggtaaaaatgttctgttcataa

SEQ ID NO: 162396 - DNA, 1779 bp, Homo sapiens
  Payload ID: 11903
  Gene Symbol: OR52A1
  Gene Name: olfactory receptor, family 52, subfamily A, member 1
  Uniprot ID: Q9UKL2
  ENST ID: ENST00000380367
  CDS Start-End: 419-1357
aaaagaagtataaatagttccagatttcctaatctctttgcatttattttgtctcctctcaacctgctaaatatcttcaggattctagaaaatgcaagtctggaaagaaataacagactggccagtagtccaatcccctgtccaggtgattttgctggttctaatgtatttggattgccatgcacataacatcctattatggcacagtgcctgtgaatgccccacctgaaaacagtgatgtatctccatgaatccatcttttcctttcaaaactgtgaataagatggatgattttagagttatacccaaatcagacagactcaatataatgagtttggagaaaatcagaaagcagaagaggaacagtaacactgactgagaaacttcttttgtttgcatcaggagacccaacgacactatgtccatttccaacatcacagtctacatgccctctgtgttgacactagtagggatcccaggcctagaatctgtgcagtgctggattgggattccattctgtgccatttatctcattgctatgattggaaattccttgcttctgagcatcatcaaatctgagcgcagtctccatgagcccttgtacattttcttaggcatgctaggagccacagacattgcacttgctagcagcattatgccaaagatgcttggaatattctggtttaatgtgcctgaaatctattttgattcctgcttgcttcaaatgtggttcatccacacattgcagggtatagagtcaggcatccttgtggccatggccctggaccgttatgtggccatctgttatccactaagacatgccaacatcttcacccaccagcttgtcattcagataggaactatggtcgtactcagggctgctattcttgtagccccatgcctagtactgataaagtgccggtttcaattttatcacacaacagtcatctcccactcctactgtgagcatatggccattgtgaaactagcagcagcaaatgttcaagtcaacaaaatctatggtttgtttgtggccttcactgtagcaggatttgacctcacattcatcacattgtcctacatccagatatttatcacagtttttcgtttgccccagaaggaggctaggtttaaagcattcaatacctgcattgctcacatctgtgtcttcctccagttctacctccttgccttcttctccttcttcacacataggtttgggtctcacatctccccttatatccatattctcttttctagcatttacttgctggtccctccatttctcaatccacttgtctatggtgcaaagaccacacagattcgcattcatgtggtaaaaatgttctgttcataaaatccaccttaattaatgcctacatgcttttttcttttgcagtagtaaccatatcaaaacaaaacaaaaaacatattatttgagatgctgggtttgtgaaatctgccagcacaatagctggttttagatcatcatggctcatatcaatcagtgggattgtgaattctacgtgactaatgaaagtgagaagtgtgaaatgagtgaagtagtgaatatatattattttttctcttttattctttagcccctggttgagttattcttctaagaatatttctccaggaggatttataaattatgcctttgtcactgaatttaaatgcacctaaggctcgttgttctgaaacatccagggactcaatgaaaacaagttgttgactctcattttcttgatcatccctgccttaaaaaaaaaaatcaaa

SEQ ID NO: 162397 - DNA, 951 bp, Homo sapiens
  Payload ID: 11904
  Gene Symbol: OR52A5
  Gene Name: olfactory receptor, family 52, subfamily A, member 5
  Uniprot ID: Q9H2C5
  ENST ID: ENST00000307388
  CDS Start-End: 1-951
atgccgacattcaatggctcagtcttcatgccctctgcgtttatactaattgggattcctggtctggagtcagtgcagtgttggattgggattcctttctctgccatgtatcttattggtgtgattggaaattccctaattttagttataatcaaatatgaaaacagcctccatatacccatgtacatttttttggccatgttggcagccacagacattgcacttaacacctgcattcttcccaaaatgttaggcatcttctggtttcatttgccagagatttcttttgatgcctgtctttttcaaatgtggcttattcactcattccaggcaattgaatcgggtatccttctggcaatggccctggatcgctatgtggccatctgtatccccttgagacatgccaccatcttttcccagcagttcttaactcatattggacttggggtgacactcagggctgccattcttataataccttccttagggctcatcaaatgctgtctgaaacactatcgaactacagtcatctctcactcttactgtgagcacatggccatcgtgaagctggctactgaagatatccgagtcaacaagatatatggcctatttgttgcctttgcaatcctagggtttgacataatatttataaccttgtcctatgtccaaatttttatcactgtctttcagctgccccagaaggaggcacgattcaaggcctttaatacatgcattgcccacatttgtgtcttcctacagttctaccttcttgccttcttctctttcttcacacacaggtttggttcacacataccaccatatattcatatcctcttgtcaaatctttacctgttagtcccaccttttctcaaccctattgtctatggagtgaagaccaagcaaattcgtgaccatattgtgaaagtgtttttcttcaaaaaagtaacttga

SEQ ID NO: 162398 - DNA, 1079 bp, Homo sapiens
  Payload ID: 11905
  Gene Symbol: OR52B2
  Gene Name: olfactory receptor, family 52, subfamily B, member 2
  Uniprot ID: Q96RD2
  ENST ID: ENST00000530810
  CDS Start-End: 83-1054
ttcgggagtgctttctgtttctatcactttcagtagactcatcagcttctaagtcattatagagaggaccataaagtgcatcatgagtcacaccaatgttaccatcttccatcctgcagtttttgtccttcctggcatccctgggttggaggcttatcacatttggctgtcaatacctctttgcctcatttacatcactgcagtcctgggaaacagcatcctgatagtggttattgtcatggaacgtaaccttcatgtgcccatgtatttcttcctctcaatgctggccgtcatggacatcctgctgtctaccaccactgtgcccaaggccctagccatcttttggcttcaagcacataacattgcttttgatgcctgtgtcacccaaggcttctttgtccatatgatgtttgtgggggagtcagctatcctgttagccatggcctttgatcgctttgtggccatttgtgccccactgagatatacaacagtgctaacatggcctgttgtggggaggattgctctggccgtcatcacccgaagcttctgcatcatcttcccagtcatattcttgctgaagcggctgcccttctgcctaaccaacattgttcctcactcctactgtgagcatattggagtggctcgtttagcctgtgctgacatcactgttaacatttggtatggcttctcagtgcccattgtcatggtcatcttggatgttatcctcatcgctgtgtcttactcactgatcctccgagcagtgtttcgtttgccctcccaggatgctcggcacaaggccctcagcacttgtggctcccacctctgtgtcatccttatgttttatgttccatccttctttaccttattgacccatcattttgggcgtaatattcctcaacatgtccatatcttgctggccaatctttatgtggcagtgccaccaatgctgaaccccattgtctatggtgtgaagactaagcagatacgtgagggtgtagcccaccggttctttgacatcaagacttggtgctgtacctcccctctgggctcatgaatcttcatgtccagctccttcaagg

SEQ ID NO: 162399 - DNA, 1124 bp, Homo sapiens
  Payload ID: 11906
  Gene Symbol: OR52B4
  Gene Name: olfactory receptor, family 52, subfamily B, member 4 (gene/pseudogene)
  Uniprot ID: Q8NGK2
  ENST ID: ENST00000408920
  CDS Start-End: 92-1036
agctcctggtgacatcgcaaagaatgttgcagattttatcttcttctacctctgtgagtaggaggtgaggttctgaaagttctccccagctatgcctactgtaaaccacagtggcactagccacacagtcttccacttgctgggcatccctggcctacaggaccagcacatgtggatttctatcccattcttcatttcctatgtcaccgcccttcttgggaacagcctgctcatcttcattatcctcacaaagcgcagcctccatgaacccatgtacctcttcctctgcatgctggctggagcagacattgtcctctccacgtgcaccattcctcaggccttagctatcttctggttccgtgctggggacatctccctggatcgttgcatcactcagctcttcttcatccattccaccttcatctctgagtcagggatcttgctggtgatggcctttgaccactatattgccatatgctacccactgaggtacaccaccattcttacaaatgctctgatcaagaaaatttgtgtgactgtctctctgagaagttatggtacaattttccctatcatatttcttttaaaaagattgactttctgccagaataatattattccacacaccttttgtgaacacattggcctagccaaatatgcatgtaatgacattcgaataaacatttggtatgggttttccattctaatgtcgacggtggtcttagatgttgtactaatttttatttcctatatgctgattctccatgctgtcttccacatgccttctccagatgcttgccacaaagctctcaacacatttggctcccatgtctgcatcatcatcctcttttatgggtctggcatcttcacaatccttacccagaggtttggacgccacattccaccttgtatccacatcccgttggctaatgtctgcattctggctccacctatgctgaatcccattatttatgggatcaaaaccaagcaaatccaggaacaggtggttcagtttttgtttataaaacagaaataactttggtttaagaactgagttttcagaatctctagctatctggtaagtgggtatgaaagtggtagatgggagaggtcagctgataccg

SEQ ID NO: 162400 - DNA, 1124 bp, Homo sapiens; identical to SEQ ID NO: 162399
  Payload ID: 11906
  Gene Symbol: OR52B4
  Gene Name: olfactory receptor, family 52, subfamily B, member 4 (gene/pseudogene)
  Uniprot ID: Q8NGK2
  ENST ID: ENST00000624801
  CDS Start-End: 92-1036

SEQ ID NO: 162401 - DNA, 1008 bp, Homo sapiens
  Payload ID: 11907
  Gene Symbol: OR52B6
  Gene Name: olfactory receptor, family 52, subfamily B, member 6
  Uniprot ID: Q8NGF0
  ENST ID: ENST00000345043
  CDS Start-End: 1-1008
atggcacaggtgagggcgctgcataaaatcatggcccttttttctgctaacagcataggtgctatgaacaactctgacactcgcatagcaggctgcttcctcactggcatccctgggctggagcaactacatatctggctgtccatccccttctgcatcatgtacatcactgccctggaaggcaatggcatcctaatttgtgtcatcctctcccaggcaatcctgcatgagcccatgtacatattcttatctatgctggccagtgctgatgtcttgctctctaccaccaccatgcctaaggccctggccaatttgtggctaggttatagcctcatttcctttgatggctgcctcactcagatgttcttcattcacttcctcttcattcactctgctgtcctgctggccatggcctttgaccgctatgtggccatctgctcccccctgcgatatgtcacaatcctcacaagcaaggtcattgggaagatcgtcactgccgccctgagccacagcttcatcattatgtttccatccatctttctccttgagcacctgcactattgccagatcaatatcattgcacacacattttgtgagcacatgggcattgcccatctgtcctgttctgatatctccatcaatgtctggtatgggttggcagctgctcttctctccacaggcctagacatcatgcttattactgtttcctacatccacatcctccaagcagtcttccgcctcctttctcaagatgcccgctccaaggccctgagtacctgtggatcccatatctgtgtcatcctactcttctatgtccctgcgcttttttctgtctttgcctacaggtttggtgggagaagcgtcccatgctatgtccatattctcctggccagcctctacgttgtcattcctcctatgctcaatcccgttatttatggagtgaggactaagccaatactggaaggggctaagcagatgttttcaaatcttgccaaaggatctaaataa

SEQ ID NO: 162402 - DNA, 1065 bp, Homo sapiens
  Payload ID: 11908
  Gene Symbol: OR52D1
  Gene Name: olfactory receptor, family 52, subfamily D, member 1
  Uniprot ID: Q9H346
  ENST ID: ENST00000322641
  CDS Start-End: 23-979
agcccttcatttgccaggaagaatgtcagattccaacctcagtgataaccatcttccagacaccttcttcttaacagggatcccagggctggaggctgcccacttctggattgccatccctttctgtgccatgtatcttgtagcactggttggaaatgctgccctcatcctggtcattgccatggacaatgctcttcatgcacctatgtacctcttcctctgccttctctcactcacagacctggctctcagttctaccactgtgcccaagatgctggccattttgtggctccatgctggtgagatttcctttggtggatgcctggcccagatgttttgtgtccattctatctatgctctggagtcctcaattctacttgccatggcctttgataggtatgtggctatctgtaacccattaaggtacacaaccattctcaaccatgctgtcataggcagaattggctttgttgggctattccgtagtgtggctattgtctcccccttcatcttcttgctgaggcgactcccctactgtggtcaccgtgtcatgacacacacatactgtgagcatatgggcattgcccgactggcctgtgccaacatcactgtcaatattgtctatgggctaactgtggctctgctggccatgggactggattccattctcattgccatttcctatggctttatcctccatgcagtctttcatcttccatctcatgatgcccagcacaaagctctgagtacctgtggctcccacattggcatcatcctggttttctacatccctgccttcttctccttcctcacccaccgctttggtcaccacgaagtccccaagcatgtgcacatctttctggctaatctctatgtgctggtgcctcctgtactcaatcctattctctatggagctagaaccaaggagattcggagtcgacttctaaaactgcttcacctggggaagacttcaatatgaatgctgagcagaagttggagatttaaaaaaaagtgtaggatggctgtctagatacatttacatggacacacagtgatgatgtgaaa

SEQ ID NO: 162403 - DNA, 978 bp, Homo sapiens
  Payload ID: 11909
  Gene Symbol: OR52E2
  Gene Name: olfactory receptor, family 52, subfamily E, member 2
  Uniprot ID: Q8NGJ4
  ENST ID: ENST00000321522
  CDS Start-End: 1-978
atgttccttcccaatgacacccagtttcacccctcctccttcctgttgctggggatcccaggactagaaacacttcacatctggatcggctttcccttctgtgctgtgtacatgatcgcactcatagggaacttcactattctacttgtgatcaagactgacagcagcctacaccagcccatgttctacttcctggccatgttggccaccactgatgtgggtctctcaacagctaccatccctaagatgcttggaatcttctggatcaacctcagagggatcatctttgaagcctgcctcacccagatgttttttatccacaacttcacacttatggagtcagcagtccttgtggcaatggcttatgacagctatgtggccatctgcaatccactccaatatagcgccatcctcaccaacaaggttgtttctgtgattggtcttggtgtgtttgtgagggctttaattttcgtcattccctctatacttcttatattgcggttgcccttctgtgggaatcatgtaattccccacacctactgtgagcacatgggtcttgctcatctatcttgtgccagcatcaaaatcaatattatttatggtttatgtgccatttgtaatctagtgtttgacatcacagtcattgccctttcttatgtgcatattctttgtgctgttttccgtcttcctactcatgaagcccgactcaagtccctcagcacatgtggttcacatgtgtgtgtaatccttgccttctatacaccagccctcttttcctttatgactcatcgctttggccgaaatgtgccccgctatatccatatactcctagccaatctctatgttgtggtgccaccaatgctcaatcctgtcatatatggagtcagaaccaagcagatctataaatgtgtgaagaaaatattattgcaggaacaaggaatggaaaaggaagagtacctaatacatacgaggttctga

SEQ ID NO: 162404 - DNA, 1030 bp, Homo sapiens
  Payload ID: 11910
  Gene Symbol: OR52E4
  Gene Name: olfactory receptor, family 52, subfamily E, member 4
  Uniprot ID: Q8NGH9
  ENST ID: ENST00000316987
  CDS Start-End: 23-961
ttcagtgacacttgctgggagaatgccttctatcaatgacacccacttctatccccccttcttcctcctgctaggaataccaggactggacactttacatatctggatttctttcccattctgtattgtgtacctgattgccattgtggggaatatgaccattctctttgtgatcaaaactgaacatagtctacaccagcccatgttctacttcctggccatgttgtctatgattgatctgggtctgtccacatccactatccccaaaatgctaggaatcttctggttcaacctccaagagatcagctttgggggatgccttcttcagatgttctttattcacatgtttacaggcatggagactgttctgttggtggtcatggcttatgaccgctttgttgccatctgcaaccctctccagtacaccatgatcctcaccaataaaaccatcagtatcctagcttctgtggttgttggaagaaatttagttcttgtaaccccatttgtgtttctcattctgcgtctgccattctgtgggcataacatcgtacctcacacatactgtgagcacaggggtctggccgggttggcctgtgcacccattaagatcaacataatctatgggctcatggtgatttcttatattattgtggatgtgatcttaattgcctcttcctatgtgcttatccttagagctgtttttcgccttccctctcaagatgtccgactaaaggccttcaatacctgtggttctcatgtctgtgttatgctgtgcttttacacaccagcatttttttcttttatgacacatcgttttggccaaaacattccccactatatccatattcttttggctaacctgtatgtggttgtcccacctgcccttaaccctgtcatttatggagtcaggaccaagcagatccgagagcaaattgtgaaaatatttgtacagaaagaataattctgtattaaagtttggataaatatatctatatacaacccaaattatcatcatctgagctcccttttt

SEQ ID NO: 162405 - DNA, 1314 bp, Homo sapiens
  Payload ID: 11911
  Gene Symbol: OR52E5
  Gene Name: olfactory receptor, family 52, subfamily E, member 5
  Uniprot ID: Q8NH55
  ENST ID: ENST00000610445
  CDS Start-End: 1-984
atgcttcataccaacaatacacagtttcacccttccaccttcctcgtagtgggggtcccagggctggaagatgtgcatgtatggattggcttccccttctttgcagtgtatctaacagcccttctagggaacatcattatcctgtttgtgatacagactgaacagagcctccaccaacccatgttttacttcctagccatgttggccggcactgatctgggcttgtctacagcaaccatccccaagatgctgggaattttctggtttaatcttggagagattgcatttggtgcctgcatcacacagatgtataccattcatatatgcactggcctggagtctgtggtactgacagtcacgggcatagatcgctatattgccatctgcaaccccctgagatatagcatgatccttaccaacaaggtaatagccattctgggcatagtcatcattgtcaggactttggtatttgtgactccattcacatttctcatcctgagattgcctttctgtggtgtccggattatccctcatacctattgtgaacacatgggcttggcaaagttagcttgtgccagtattaatgttatatatggattgattgccttctcagtgggatacattgacatttctgtgattggattttcctatgtccagatcctccgagctgtcttccatctcccagcctgggatgcccggcctaaggcactcagcacatgtggctctcacgtctgtgttatgttggctttctacctgccagccctcttttccttcatgacacaccgctttggccacaacatccctcattacatccacattcttctggccaatctgtatgtggtttttccccctgctcttaactctgttatctatggggtcaaaacaaaacagatacgagagcaggtacttaggatactcaaccctaaaagcttttggcattttgaccccaagaggatcttccacaacaattcagttagacaataatgagatcataacaaaataaacactggaaacattttttttactacttctcttgcattcccacatgagccaatagcattatatcccctacaacgtctcatgatttcagtacggtctgttggaagttatagctcaaagattccaaaacaatctctctgtttcacccattaaaagtgcaaaaagtactcacacttaagccccatgatactacaaaatgcctaaagagaaacaaaggctttgtaaaagttattgcccagtaattgtcttgaatagcctttccacatgaagattctctgtatttacatatccaaagctgaagttcatgacgattaa

SEQ ID NO: 162406 - DNA, 970 bp, Homo sapiens
  Payload ID: 11912
  Gene Symbol: OR52E6
  Gene Name: olfactory receptor, family 52, subfamily E, member 6
  Uniprot ID: Q96RD3
  ENST ID: ENST00000329322
  CDS Start-End: 1-942
atgcctatagctaacgacacccagttccatacttcttcattcctactgctgggtatcccagggctagaagatgtgcacatctggattggattcccttttttctctgtgtatcttattgcactcctgggaaatgctgctatcttctttgtgatccaaactgagcagagtctccatgagcccatgtactactgcctggccatgttggattccattgacctgagcttgtctacggccaccattcccaaaatgctgggcatcttctggttcaatatcaaggaaatatcttttggaggctacctttctcagatgttcttcatccatttcttcactgtcatggagagcatcgtattggtggccatggcctttgaccgctacattgccatttgcaaacctctttggtacaccatgatcctcaccagcaaaatcatcagcctcattgcaggcattgctgtcctgaggagcttgtacatggtcattccactggtgtttctcctcttaaggttgcccttctgtggacatcgtatcatccctcatacttactgtgagcacatgggcattgcccgtctggcctgtgccagcatcaaagtcaacattatgtttggtcttggcagtatttctctcttgttattggatgtgctccttattattctctcccatatcaggatcctctatgctgtcttctgcctgccctcctgggaagctcgactcaaagctctcaacacctgtggctctcacattggtgttatcttagccttttctacaccagcatttttctctttctttacacactgctttggccatgatattccccaatatatccacattttcttggctaatctatatgtggttgttcctcccaccctcaatcctgtaatctatggggtcagaaccaaacatattagggagacagtgctgaggattttcttcaagacagatcactaaccagttggagtttggagggtctctctta

SEQ ID NO: 162407 - DNA, 954 bp, Homo sapiens
  Payload ID: 11912
  Gene Symbol: OR52E6
  Gene Name: olfactory receptor, family 52, subfamily E, member 6
  ENST ID: ENST00000379946
  CDS Start-End: 1-954
atggaaaaaagaatgcctatagctaacgacacccagttccatacttcttcattcctactgctgggtatcccagggctagaagatgtgcacatctggattggattcccttttttctctgtgtatcttattgcactcctgggaaatgctgctatcttctttgtgatccaaactgagcagagtctccatgagcccatgtactactgcctggccatgttggattccattgacctgagcttgtctacggccaccattcccaaaatgctgggcatcttctggttcaatatcaaggaaatatcttttggaggctacctttctcagatgttcttcatccatttcttcactgtcatggagagcatcgtattggtggccatggcctttgaccgctacattgccatttgcaaacctctttggtacaccatgatcctcaccagcaaaatcatcagcctcattgcaggcattgctgtcctgaggagcttgtacatggtcattccactggtgtttctcctcttaaggttgcccttctgtggacatcgtatcatccctcatacttactgtgagcacatgggcattgcccgtctggcctgtgccagcatcaaagtcaacattatgtttggtcttggcagtatttctctcttgttattggatgtgctccttattattctctcccatatcaggatcctctatgctgtcttctgcctgccctcctgggaagctcgactcaaagctctcaacacctgtggctctcacattggtgttatcttagccttttctacaccagcatttttctctttctttacacactgctttggccatgatattccccaatatatccacattttcttggctaatctatatgtggttgttcctcccaccctcaatcctgtaatctatggggtcagaaccaaacatattagggagacagtgctgaggattttcttcaagacagatcactaa

SEQ ID NO: 162408 - DNA, 1061 bp, Homo sapiens
  Payload ID: 11913
  Gene Symbol: OR52E8
  Gene Name: olfactory receptor, family 52, subfamily E, member 8
  Uniprot ID: Q6IFG1
  ENST ID: ENST00000537935
  CDS Start-End: 33-986
ataatcgtcgctggtgtgcccagcagctttatatggcaggaagaatgtctacgtctaatcacacccagttccatccttcttcattcctactgctgggtatcccagggctagaagatgtgcacatttggattggagtcccttttttctttgtgtatcttgttgcactcctgggaaacactgctctcttgtttgtgatccagactgagcagagtctccatgagcctatgtactacttcctggccatgttggattccattgacctgggcttgtctacagccaccatccccaaaatgttgggcatcttctggttcaataccaaagaaatatcttttggaggctgcctttctcacatgttcttcatccatttcttcactgctatggagagcattgtgttggtggccatggcctttgaccgctacattgccatttgcaaacctcttcggtacaccatgatcctcaccagcaaaatcatcagcctcattgcaggcattgctgtcctgaggagcctgtacatggttgttccactggtgtttctccttctgaggctgcccttctgtgggcatcgtatcatccctcatacttattgtgagcacatgggcattgcccgtctggcctgtgccagcatcaaagtcaacattaggtttggccttggcaacatatctctcttgttactggatgttatccttattattctctcctatgtcaggatcctgtatgctgtcttctgcctgccctcctgggaagctcgactcaaagctctcaacacctgtggttctcatattggtgttatcttagccttttttacaccagcatttttttcattcttgacacatcgttttggccataatatcccacagtatatacatattatattagccaacctgtatgtggttgtcccaccagccctcaatcctgtaatctatggagtcaggacaaagcagattcgagagagagtgctgaggatttttctcaagaccaatcactaaccagttggaggttggagagtctgtcactctaacctaatagaaagcagaaaaacagaagggaatgctgcagccaat

SEQ ID NO: 162409 - DNA, 963 bp, Homo sapiens
  Payload ID: 11914
  Gene Symbol: OR52H1
  Gene Name: olfactory receptor, family 52, subfamily H, member 1
  Uniprot ID: Q8NGJ2
  ENST ID: ENST00000322653
  CDS Start-End: 1-963
atgccatctgcctctgccatgatcattttcaacctgagcagttacaatccaggacccttcattctggtagggatcccaggcctggagcaattccatgtgtggattggaattcccttctgtatcatctacattgtagctgttgtgggaaactgcatccttctctacctcattgtggtggagcatagtcttcatgaacccatgttcttctttctctccatgctggccatgactgacctcatcttgtccacagctggtgtgcctaaagcactcagtatcttttggctaggggctcgcgaaatcacattcccaggatgccttacacaaatgttcttccttcactataactttgtcctggattcagccattctgatggccatggcatttgatcactatgtagctatctgttctcccttgagatataccaccatcttgactcccaagaccatcatcaagagtgctatgggcatctcctttcgaagcttctgcatcatcctgccagatgtattcttgctgacatgcctgcctttctgcaggacacgcatcataccccacacatactgtgagcatataggtgttgcccagctcgcctgtgctgatatctccatcaacttctggtatggcttttgtgttcccatcatgacggtcatctcagatgtgattctcattgctgtttcctacgcacacatcctctgtgctgtctttggccttccctcccaagatgcctgccagaaagccctcggcacttgtggttctcatgtctgtgtcatcctcatgttttatacacctgcctttttctccatcctcgcccatcgctttggacacaatgtctctcgcaccttccacatcatgtttgccaatctctacattgttatcccacctgcactcaaccccatggtttacggagtgaagaccaagcagatcagagataaggttatacttttgttttctaagggtacaggatga

SEQ ID NO: 162410 - DNA, 1050 bp, Homo sapiens
  Payload ID: 11915
  Gene Symbol: OR52I1
  Gene Name: olfactory receptor, family 52, subfamily I, member 1
  ENST ID: ENST00000450052
  CDS Start-End: 1-1050
tgcaaaagagtattagaagactgcaccattctcttacatcatctatacattaataggcaagaagtctcacctgtgatgctgggtccagcttacaaccacacaatggaaacccctgcctccttcctccttgtgggtatcccaggactgcaatcttcacatctttggctggctatctcactgagtgccatgtacatcacagccctgttaggaaacaccctcatcgtgactgcaatctggatggattccactcggcatgagcccatgtattgctttctgtgtgttctggctgctgtggacattgttatggcctcctccgtggtacccaagatggtgagcatcttctgctcgggagacagctccatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccgtcaccatcagagctgtcacattcatgactccactgagttggatgatgaatcatctacctttctgtggctccaatgtggttgtccactcctactgtaagcacatagctttggccaggttagcatgtgctgaccccgtgcccagcagtctctacagtctgattggttcctctcttatggtgggctctgatgtggccttcattgctgcctcctatatcttaattctcagggcagtatttgatctctcctcaaagactgctcagttgaaagcattaagcacatgtggctcccatgtgggggttatggctttgtactatctacctgggatggcatccatctatgcggcctggttggggcaggatatagtgcccttgcacacccaagtgctgctagctgacctgtacgtgatcatcccagccactttaaatcccatcatctatggcatgaggaccaaacaattgctggagggaatatggagttatctgatgcacttcctctttgaccactccaacctgggttcatga

SEQ ID NO: 162411 - DNA, 975 bp, Homo sapiens
  Payload ID: 11915
  Gene Symbol: OR52I1
  Gene Name: olfactory receptor, family 52, subfamily I, member 1
  Uniprot ID: Q8NGK6
  ENST ID: ENST00000530443
  CDS Start-End: 1-975
atgctgggtccagcttacaaccacacaatggaaacccctgcctccttcctccttgtgggtatcccaggactgcaatcttcacatctttggctggctatctcactgagtgccatgtacatcacagccctgttaggaaacaccctcatcgtgactgcaatctggatggattccactcggcatgagcccatgtattgctttctgtgtgttctggctgctgtggacattgttatggcctcctccgtggtacccaagatggtgagcatcttctgctcgggagacagctccatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccgtcaccatcagagctgtcacattcatgactccactgagttggatgatgaatcatctacctttctgtggctccaatgtggttgtccactcctactgtaagcacatagctttggccaggttagcatgtgctgaccccgtgcccagcagtctctacagtctgattggttcctctcttatggtgggctctgatgtggccttcattgctgcctcctatatcttaattctcagggcagtatttgatctctcctcaaagactgctcagttgaaagcattaagcacatgtggctcccatgtgggggttatggctttgtactatctacctgggatggcatccatctatgcggcctggttggggcaggatatagtgcccttgcacacccaagtgctgctagctgacctgtacgtgatcatcccagccactttaaatcccatcatctatggcatgaggaccaaacaattgctggagggaatatggagttatctgatgcacttcctctttgaccactccaacctgggttcatga

SEQ ID NO: 162412 - DNA, 1115 bp, Homo sapiens
  Payload ID: 11916
  Gene Symbol: OR52I2
  Gene Name: olfactory receptor, family 52, subfamily I, member 2
  Uniprot ID: Q8NH67
  ENST ID: ENST00000312614
  CDS Start-End: 23-1075
ccttaggttttcccagcaccacatgtgtcaacaaatcttacgggattgcattcttctcatacatcatttgtgcattaacaggaaaaaagtctcacttgtgatgctgggtccagcttataaccacacaatggaaacccctgcctccttcctccttgtgggtatcccaggactgcaatcttcacatctttggctggctatctcactgagtgccatgtacatcatagccctgttaggaaacaccatcatcgtgactgcaatctggatggattccactcggcatgagcccatgtattgctttctgtgtgttctggctgctgtggacattgttatggcctcctcggtggtacccaagatggtgagcatcttctgctcaggagacagctcaatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccatcaccatcagagctatcatagccataactccactgagttggatggtgagtcatctacctttctgtggctccaatgtggttgtccactcctactgtgagcacatagctttggccaggttagcatgtgctgaccccgtgcccagcagtctctacagtctgattggttcctctcttatggtgggctctgatgtggccttcattgctgcctcctatatcttaattctcaaggcagtatttggtctctcctcaaagactgctcagttgaaagcattaagcacatgtggctcccatgtgggggttatggctttgtactatctacctgggatggcatccatctatgcggcctggttggggcaggatgtagtgcccttgcacacccaagtcctgctagctgacctgtacgtgatcatcccagccaccttaaatcccatcatctatggcatgaggaccaaacaactgcgggagagaatatggagttatctgatgcatgtcctctttgaccattccaacctgggttcatgaacacaatatctgttcagatccagccaatttcaaagatgcc

SEQ ID NO: 162413 - DNA, 936 bp, Homo sapiens
  Payload ID: 11917
  Gene Symbol: OR52J3
  Gene Name: olfactory receptor, family 52, subfamily J, member 3
  Uniprot ID: Q8NH60
  ENST ID: ENST00000380370
  CDS Start-End: 1-936
atgttttatcacaacaagagcatatttcacccagtcacatttttcctcattggaatcccaggtctggaagacttccacatgtggatctccgggcctttctgctctgtttaccttgtggctttgctgggcaatgccaccattctgctagtcatcaaggtagaacagactctccgggagcccatgttctacttcctggccattctttccactattgatttggccctttctacaacctctgtgcctcgcatgctgggtatcttctggtttgatgctcacgagattaactatggagcttgtgtggcccagatgtttctgatccatgccttcactggcatggaggctgaggtcttactggctatggcttttgaccgttatgtggccgtctgtgctccactacattacgcaaccatcttgacatcccaagtgttggtgggcattagcatgtgcattgtaattcgtcccgttttacttacacttcccatggtctatcttatctaccgcctacccttttgtcaggctcacataatagcccattcctactgtgagcacatgggcattgcaaaattgtcctgtggaaacattcgtatcaatggtatctatgggctttttgtagtttctttctttgttctgaacctggtgctcattggcatctcgtatgtttacattctccgtgctgtcttccgcctcccatcacatgatgctcagctaaaagccctaagcacgtgtggcgctcatgttggagtcatctgtgttttctatatcccttcagtcttctctttccttactcatcgatttggacaccaaataccaggttacattcacattcttgttgccaatctctatttgattatcccaccctctctcaaccccatcatttatggggtgaggaccaaacagattcgagaacgagtgctctatgtttttactaaaaaataa

SEQ ID NO: 162414 - DNA, 1030 bp, Homo sapiens
  Payload ID: 11918
  Gene Symbol: OR52K1
  Gene Name: olfactory receptor, family 52, subfamily K, member 1
  Uniprot ID: Q8NGK4
  ENST ID: ENST00000307632
  CDS Start-End: 23-967
gacaaggagatttccaggagccatgcttccctctaatatcacctcaacacatccagctgtctttttgttggtaggaattcctggtttggaacacctgcatgcctggatctccatccccttctgctttgcttatactctggccctgctaggcaactgtacccttctcttcattatccaggctgatgcagccctccatgaacccatgtacctctttctggccatgttggcaaccattgacttggttctttcttctacaacgctgcccaaaatgcttgccatattctggttcagggatcaggagatcaacttctttgcctgtctggtccagatgttcttccttcactccttctccatcatggagtcagcagtgctgctggccatggcctttgaccgctatgtggccatctgcaagccattgcactacacgacggtcctgactgggtccctcatcaccaagattggcatggctgctgtggcccgggctgtgacactaatgactccactccccttcctgctcagacgcttccactactgccgaggcccagtgattgcccattgctactgtgaacacatggctgtggtaaggctggcgtgtggggacactagcttcaacaatatctatggcattgctgtggccatgtttattgtggtgttggacctgctctttgttatcctgtcttatgtcttcatccttcaggcagttctccagcttgcctctcaggaggcccgctacaaggcatttgggacatgtgtgtctcacataggtgccatcctgtccacctacactccagtagtcatctcttcagtcatgcaccgtgtagcccgccatgctgcccctcgtgtccacatactccttgctattttctatctccttttcccacccatggtcaatcctatcatatatggagtcaagaccaagcagattcgtgagtatgtgctcagtctattccagagaaagaacatgtagatggatagttctctttttttatcccacttgccaagtaatgagaatgctggattggggttgagg

SEQ ID NO: 162415 - DNA, 1067 bp, Homo sapiens
  Payload ID: 11919
  Gene Symbol: OR52K2
  Gene Name: olfactory receptor, family 52, subfamily K, member 2
  Uniprot ID: Q8NGK3
  ENST ID: ENST00000325719
  CDS Start-End: 46-990
gggccctgtggaagcagataaggaggaagagaattcccaggagccatgtcagcctccaatatcaccttaacacatccaactgccttcttgttggtggggattccaggcctggaacacctgcacatctggatctccatccctttctgcttagcatatacactggccctgcttggaaactgcactctccttctcatcatccaggctgatgcagccctccatgaacccatgtacctctttctggccatgttggcagccatcgacctggtcctttcctcctcagcactgcccaaaatgcttgccatattctggttcagggatcgggagataaacttctttgcctgtctggcccagatgttcttccttcactccttctccatcatggagtcagcagtgctgctggccatggcctttgaccgctatgtggctatctgcaagccactgcactacaccaaggtcctgactgggtccctcatcaccaagattggcatggctgctgtggcccgggctgtgacactaatgactccactccccttcctgctgagatgtttccactactgccgaggcccagtgatcgctcactgctactgtgaacacatggctgtggtgaggctggcgtgtggggacactagcttcaacaatatctatggcatcgctgtggccatgtttattgtggtgttggacctgctccttgttatcctgtcttatatctttattcttcaggcagttctactgcttgcctctcaggaggcccgctacaaggcatttgggacatgtgtctctcatataggtgccatcttagccttctacacaactgtggtcatctcttcagtcatgcaccgtgtagcccgccatgctgcccctcatgtccacatcctccttgccaatttctatctgctcttcccacccatggtcaatcccataatctatggtgtcaagaccaagcaaatccgtgagagcatcttgggagtattcccaagaaaggatatgtagagggtgaggtggagaaagaatgggttggcttgtctgctggagttggagacaggctatggtagaatgtgcacggctgc

SEQ ID NO: 162416 - DNA, 1094 bp, Homo sapiens
  Payload ID: 11920
  Gene Symbol: OR52L1
  Gene Name: olfactory receptor, family 52, subfamily L, member 1
  Uniprot ID: Q8NGH7
  ENST ID: ENST00000332249
  CDS Start-End: 56-1045
ggatgatggttgccccatttggacaatgtgataatgtagcaggaatgcagaaatcatgactttggtttcttttttctctttcctctccaagccattgataatgctccttagcaattcaagctggaggctatcccagccttcttttctcctggtagggattccaggtttagaggaaagccagcactggattgcactgcccctgggcatcctttacctccttgctttagtgggcaatgttaccattctcttcatcatctggatggacccatccttgcaccaatctatgtacctcttcctgtccatgctagctgccatcgacctggttctggcctcctccactgcacccaaagcccttgcagtgctcctggttcatgcccacgagattgggtacatcgtctgcctgatccagatgttcttcatccatgcattctcctccatggagtcaggggtacttgtggccatggctctggatcgctatgtagccatttgtcaccccttgcaccattccacaatcctgcatccaggggtcatagggcgcatcggaatggtggtgctggtgaggggattactactccttatccccttccccattttgttgggaacacttatcttctgccaagccaccatcataggccatgcctattgtgaacatatggctgttgtgaaacttgcctgctcagaaaccacagtcaatcgagcttatgggctgactatggccttgcttgtgattgggctggatgttctggccattggtgtttcctatgcccacatcctccaggcagtgctgaaggtaccagggagtgaggcccgacttaaggcgtttagcacatgtggctctcatatttgtgtcatcctggtcttctatgtccctggaattttctccttcctcactcaccgctttggtcatcatgtaccccatcatgtccatgttcttctggccacacggtatctcctcatgccacctgcgctcaatcctcttgtctatggagtgaagactcagcagatccgccagcgagtgctcagagtgtttacacaaaaggattgatctgaacatattctcattgtttccttcggaggcttcttctgcggaccac

SEQ ID NO: 162417 - DNA, 954 bp, Homo sapiens
  Payload ID: 11921
  Gene Symbol: OR52M1
  Gene Name: olfactory receptor, family 52, subfamily M, member 1
  Uniprot ID: Q8NGK5
  ENST ID: ENST00000360213
  CDS Start-End: 1-954
atgctcacttttcataatgtctgctcagtacccagctccttctggctcactggcatcccagggctggagtccctacacgtctggctctccatcccctttggctccatgtacctggtggctgtggtggggaatgtgaccatcctggctgtggtaaagatagaacgcagcctgcaccagcccatgtactttttcttgtgcatgttggctgccattgacctggttctgtctacttccactatacccaaacttctgggaatcttctggttcggtgcttgtgacattggcctggacgcctgcttgggccaaatgttccttatccactgctttgccactgttgagtcaggcatcttccttgccatggcttttgatcgctacgtggccatctgcaacccactacgtcatagcatggtgctcacttatacagtggtgggtcgtttggggcttgtttctctcctccggggtgttctctacattggacctctgcctctgatgatccgcctgcggctgcccctttataaaacccatgttatctcccactcctactgtgagcacatggctgtagttgccttgacatgtggcgacagcagggtcaataatgtctatgggctgagcatcggctttctggtgttgatcctggactcagtggctattgctgcatcctatgtgatgattttcagggccgtgatggggttagccactcctgaggctaggcttaaaaccctggggacatgcgcttctcacctctgtgccatcctgatcttttatgttcccattgctgtttcttccctgattcaccgatttggtcagtgtgtgcctcctccagtccacactctgctggccaacttctatctcctcattcctccaatcctcaatcccattgtctatgctgttcgcaccaagcagatccgagagagccttctccaaataccaaggatagaaatgaagattagatga

SEQ ID NO: 162418 - DNA, 963 bp, Homo sapiens
  Payload ID: 11922
  Gene Symbol: OR52N1
  Gene Name: olfactory receptor, family 52, subfamily N, member 1
  Uniprot ID: Q8NH53
  ENST ID: ENST00000317078
  CDS Start-End: 1-963
atgtcatttctaaatggcaccagcctaactccagcttcattcatcctaaatggcatccctggtttggaagatgtgcatttgtggatctccttcccactgtgtaccatgtacagcattgctattacagggaacttcggccttatgtacctcatctactgtgatgaggccttacacagacctatgtatgtcttccttgcccttctttccttcacagatgtgctcatgtgcaccagcacccttcccaacactctcttcatattgtggtttaatctcaaggagattgattttaaagcctgcctcgcccagatgttctttgtgcacaccttcacagggatggagtctggggtgctcatgctcatggccctggaccactgtgtggccatctgcttccctctgcgttatgccaccatcctcactaattcagtcattgctaaagctgggttcctcacttttcttaggggtgtgatgcttgttatcccttccactttcctcaccaagcgccttccatactgcaagggcaacgtcataccccacacctactgtgaccacatgtctgtggccaagatatcttgtggtaatgtcagggttaacgccatctatggtttgatagttgccctgctgattgggggctttgatatcctgtgcattacaatctcctacactatgattcttcaagcagttgtgagtctatcatcagcagatgctcgacagaaggccttcagcacctgcactgcccacttctgtgccatagtcctcacctatgttccagccttctttaccttctttacacaccattttgggggacacaccattcctctacacatacatattattatggctaatctctacctactaatgcctcccacaatgaaccctattgtgtatggggtgaaaaccaggcaggtacgagaaagtgtcattaggttctttcttaagggaaaggacaattctcataacttttaa

SEQ ID NO: 162419 - DNA, 1035 bp, Homo sapiens
  Payload ID: 11923
  Gene Symbol: OR52N2
  Gene Name: olfactory receptor, family 52, subfamily N, member 2
  Uniprot ID: Q8NGI0
  ENST ID: ENST00000317037
  CDS Start-End: 23-988
tgctctcctcctgtcagccatcatgtctggggacaacagctccagcctgaccccaggattctttatcttgaatggcgttcctgggctggaagccacacacatctggatctccctgccattctgctttatgtacatcattgctgtcgtggggaactgtgggctcatctgcctcatcagccatgaggaggccctgcaccggcccatgtactacttcctggccctgctctccttcactgatgtcaccttgtgcaccaccatggtacctaatatgctgtgcatattctggttcaacctcaaggagattgactttaacgcctgcctggcccagatgttttttgtccatatgctgacagggatggagtctggggtgctcatgctcatggccctggaccgctatgtggccatctgctaccccttacgctatgccaccatccttaccaaccctgtcatcgccaaggctggtcttgccaccttcttgaggaatgtgatgctcatcatcccattcactctcctcaccaagcgcctgccctattgccgggggaacttcatcccccacacctactgtgaccatatgtctgtggccaaggtatcctgtggcaatttcaaggtcaatgctatttatggtctgatggttgctctcctgattggtgtgtttgatatctgctgtatctctgtatcttacactatgattttgcaggctgttatgagcctgtcatcagcagatgctcgtcacaaagccttcagcacctgcacatctcacatgtgttccattgtgatcacctatgttgctgcttttttcacttttttcactcatcgttttgtaggacacaatatcccaaaccacatacacatcatcgtggccaacctttatctgctactgcctcctaccatgaacccaattgtttatggagtcaagaccaagcagattcaggaaggtgtaattaaatttttacttggagacaaggttagttttacctatgacaaatgaaacatagaatagacatattgtttcaggtggtgagaaaataatggaga

SEQ ID NO: 162420 - DNA, 1037 bp, Homo sapiens
  Payload ID: 11924
  Gene Symbol: OR52N4
  Gene Name: olfactory receptor, family 52, subfamily N, member 4 (gene/pseudogene)
  Uniprot ID: Q8NGI2
  ENST ID: ENST00000317254
  CDS Start-End: 49-1014
gaaagcccagacaaattttgagctatttcataacctaccagacttatcatgctaacactgaataaaacagacctaataccagcttcatttattctgaatggagtcccaggactggaagacacacaactctggatttccttcccattctgctctatgtatgttgtggctatggtagggaattgtggactcctctacctcattcactatgaggatgccctgcacaaacccatgtactacttcttggccatgctttcctttactgaccttgttatgtgctctagtacaatccctaaagccctctgcatcttctggtttcatctcaaggacattggatttgatgaatgccttgtccagatgttcttcacccacaccttcacagggatggagtctggggtgcttatgcttatggccctggatcgctatgtggccatctgctaccccttacgctattcaactatcctcaccaatcctgtaattgcaaaggttgggactgccaccttcctgagaggggtattactcattattccctttactttcctcaccaagctcctgccctactgcagaggcaatatacttccccatacctactgtgaccacatgtctgtagccaaattgtcctgtggtaatgtcaaggtcaatgccatctatggtctgatggttgccctcctgatttggggctttgacatactgtgtatcaccaactcctataccatgattctccgggcagtggtcagcctctcctcagcagatgctcggcagaaggcctttaatacctgcactgcccacatttgtgccattgttttctcctatactccagctttcttctccttcttttcccaccgctttggggaacacataatccccccttcttgccacatcattgtagccaatatttatctgctcctaccacccactatgaaccctattgtctatggggtgaaaaccaaacagatacgagactgtgtcataaggatcctttcaggttctaaggataccaaatcctacagcatgtgaatgaacacttgccaggagtgaga

SEQ ID NO: 162421 - DNA, 1034 bp, Homo sapiens
  Payload ID: 11925
  Gene Symbol: OR52N5
  Gene Name: olfactory receptor, family 52, subfamily N, member 5
  Uniprot ID: Q8NH56
  ENST ID: ENST00000317093
  CDS Start-End: 34-1008
ttctcttcaggatgaaacttctggaaaaatagaatgcctctatttaattcattatgctggtttccaacaattcatgtgactcctccatcttttattcttaatggaatacctggtctggaaagagtacatgtatggatctccctcccactctgcacaatgtacatcatcttccttgtggggaatcttggtcttgtgtacctcatttattatgaggagtccttacatcatccgatgtattttttttttggccatgctctctccctcattgacctccttacctgcaccaccactctacccaatgcactctgcatcttctggttcagtctcaaagaaattaacttcaatgcttgcttggcccagatgttctttgttcatgggttcacaggtgtggagtctggggtgctcatgctcatggctctagaccgctatgtagccatttgctaccctttgcgttatgctaccacactcaccaaccctatcattgccaaggctgagcttgccaccttcctgaggggtgtattgctgatgattcctttcccattcttggttaagcgtttgcctttctgccaaagcaatattatctcccatacgtactgcgaccacatgtctgtagtaaagctatcttgtgccagcatcaaggtcaatgtaatctatggtctaatggttgctctcctgattggagtgtttgacatttgttgtatatctttgtcttacactttgatcctcaaggcagcgatcagcctctcttcatcagatgctcggcagaaggctttcagcacctgcactgcccatatatctgccatcatcatcacctatgttccagcattcttcactttctttgcccaccgttttgggggacacacaattcccccttctcttcacatcattgtggctaatctttatcttcttcttcccccaactctaaaccctattgtttatggagtaaagacaaaacagatacgcaagagtgtcataaagttcttccagggtgataagggtgcaggttgattcaaggcaacttaattcagatggaa

SEQ ID NO: 162422 - DNA, 948 bp, Homo sapiens; identical to SEQ ID NO: 161889
  Payload ID: 11926
  Gene Symbol: OR52R1
  Gene Name: olfactory receptor, family 52, subfamily R, member 1 (gene/pseudogene)
  Uniprot ID: Q8NGF1
  ENST ID: ENST00000356069
  CDS Start-End: 1-948

SEQ ID NO: 162423 - DNA, 1114 bp, Homo sapiens
  Payload ID: 11927
  Gene Symbol: OR52W1
  Gene Name: olfactory receptor, family 52, subfamily W, member 1
  Uniprot ID: Q6IF63
  ENST ID: ENST00000311352
  CDS Start-End: 79-1041
gacccccaaaatctctccccttatcttccctgtcaggagtcatgcccccatgagccctcaagttgtgcccaccacagaatggcagaaactctacaactcaattccaccttcctacacccaaacttcttcatactgactggctttccagggctaggaagtgcccagacttggctgacactggtctttgggcccatttatctgctggccctgctgggcaatggagcactgccggcagtggtgtggatagactccacactgcaccagcccatgtttctactgttggccatcctggcagccacagacctgggcttagccacatctatagccccagggttgctggctgtgctgtggcttgggccccgatctgtgccatatgctgtgtgcctggtccagatgttctttgtacatgcactgactgccatggaatcaggtgtgcttttggccatggcctgtgatcgtgctgcggcaatagggcgtccactgcactaccctgtcctggtcaccaaagcctgtgtgggttatgcagccttggccctggcactgaaagctgtggctattgttgtacctttcccactgctggtggcaaagtttgagcacttccaagccaagaccataggccatacctattgtgcacacatggcagtggtagaactggtggtgggtaacacacaggccaccaacttatatggtctggcactttcactggccatctcaggtatggatattctgggtatcactggctcctatggactcattgcccatgctgtgctgcagctacctacccgggaggcccatgccaaggcctttggtacatgtagttctcacatctgtgtcattctggccttctacatacctggtctcttctcctacctcacacaccgctttggtcatcacactgtcccaaagcctgtgcacatccttctctccaacatctacttgctgctgccacctgccctcaaccccctcatctatggggcccgcaccaagcagatcagagaccgactcctggaaaccttcacattcagaaaaagcccgttgtaatgtccagtggtaacaatggagcctaagagtggaggtgaggggacaatcggaggggagtctgggggtgtggatc

SEQ ID NO: 162424 - DNA, 897 bp, Homo sapiens
  Payload ID: 11928
  Gene Symbol: OR52Z1
  Gene Name: olfactory receptor, family 52, subfamily Z, member 1 (gene/pseudogene)
  ENST ID: ENST00000510471
  CDS Start-End: 1-897
atgggaatcccagggctggaaggcttgcatacctggatctccatccctttttcttttatgtacattgtggctgttgcaggcaatatcttcttgatcttcctgatcatgactgagcgcagtctccatgagcccatgtatctcttcctatccatgctggcctcagccgacttcctgctcgccactgctgcagcccctaaggtgctggctatcctctggttccactccatggacatatcctttggtagttgtgtgtctcagatgttcttcatacatttcatctttgtggcagaatctgctattctcctggcaatggcatttgaccgctatgtggccatctgttacccactgagatacaccattttaacctcatcagccgtcaggaagattggcatagcagctgtggtcaggagctttttcatctgctgtccgttcatcttcctggtataccgacttacatattgtgggagaaacatcattcctcattcctactgtgagcacattgccagattggcttgtggcaatatcaatgtcaatatcatttatggcctcactgtggccctactctctacaggactggatatagtgcttatcattatatcctacacaatgatccttcactcagtgtttcagatatcttcctgggctgccaggttcaaggcccttagtacgtgcggctctcatatctgtgtcatatttatgttctataccccagcattcttttcatttcttgcccatcgctttggaggtaaaaccatccctcaccacattcacatcctagtgggcagtctctatgtgttagtgccccctatgctaaaccccatcatttatggggtgaagaccaaacaaattaaagatcgagtgattttgcttttctctcctatcagtgtatgctgttaa

SEQ ID NO: 162425 - DNA, 1071 bp, Homo sapiens
  Payload ID: 11929
  Gene Symbol: OR56A1
  Gene Name: olfactory receptor, family 56, subfamily A, member 1
  Uniprot ID: Q8NGH5
  ENST ID: ENST00000316650
  CDS Start-End: 38-994
tgcccataaacatagtcatcagaagcctactcagctcatgattcagcctatggcgtcacccagcaacagctccactgtcccagtctctgaattcctcctcatctgcttccccaacttccagagttggcagcactggctctccctgcccctcagccttctcttcctcctggccatgggagctaacaccaccctcctgatcaccatccagctggaggcctctctgcaccagcccctgtactacctgctcagcctcctctccctgctggacatcgtgctctgcctcaccgtcatccccaaggtcctggccatcttctggtatgatcttaggtcgatcagcttccctgcctgcttcctccagatgttcatcatgaacagtttcctccccatggagtcctgcacgtttatggtcatggcctatgaccgttatgtggccatctgccacccactgcggtacccatccatcatcactaatcaatttgtggccaaagctagtgtcttcattgtggtgcggaatgcgcttcttactgcacccattcctatcctcacttccctgctccattactgtggggaaaatgtcattgagaactgcatctgtgccaacttgtctgtgtccaggctctcctgtgataatttcacccttaacagaatctaccaatttgtggctggttggaccttgctgggctcagatttattcctcatcttcctctcttacaccttcattctaagagctgtgcttagattcaaagcagagggggcggcagtgaaggccctgagcacatgtggctcccacttcatcctcattcttttcttcagcaccatactgctggttgtggtgttgacaaacgtggccagaaagaaggtccccatggacatcctgatcctgctgaacgtccttcatcaccttattcctcctgcattgaaccctattgtgtatggggttcggaccaaagagataaaacagggaattcagaagttactgcagagagggaggtgaatatgtaaagcatttctaatacctcctgttcttcctcttcagtgattttacctaggcagcgaagtagagaaatgtca

SEQ ID NO: 162426 - DNA, 1022 bp, Homo sapiens
  Payload ID: 11930
  Gene Symbol: OR56A3
  Gene Name: olfactory receptor, family 56, subfamily A, member 3
  Uniprot ID: Q8NH54
  ENST ID: ENST00000329564
  CDS Start-End: 8-955
ggaaaatatgacaacacaccgaaatgacaccctctccactgaagcttcagacttcctcttgaattgttttgtcagatcccccagctggcagcactggctgtccctgcccctcagcctccttttcctcttggccgtaggggccaacaccaccctcctgatgaccatctggctggaggcctctctgcaccagcccctgtactacctgctcagcctcctctccctgctggacatcgtgctctgcctcactgtcatccccaaggtcctgaccatcttctggtttgacctcaggcccatcagcttccctgcctgcttcctccagatgtacatcatgaattgtttcctagccatggagtcttgcacattcatggtcatggcctatgatcgttatgtagccatctgccacccactgagatatccatcaatcatcactgatcactttgtagtcaaggctgccatgtttattttgaccagaaatgtgcttatgactctgcccatccccatcctttcagcacaactccgttattgtggaagaaatgtcattgagaactgcatctgtgccaatatgtctgtttccagactctcctgcgatgatgtcaccatcaatcacctttaccaatttgctggaggctggactctgctaggatctgacctcatccttatcttcctctcctacaccttcattctgcgagctgtgctgagactcaaggcagagggtgccgtggcaaaggccctaagcacatgtggctcccacttcatgctcatcctcttcttcagcaccatccttctggtttttgtcctcacacatgtggctaagaagaaagtctcccctgatgtgccagtcttgctcaatgttctccaccatgtcattcctgcagcccttaaccccatcatttacggggtgagaacccaagaaattaagcagggaatgcagaggttgttgaagaaagggtgctaacaaggaccactggatctctgaatatctaaaataagataatttattaatcacttaatgagtgagtggg

SEQ ID NO: 162427 - DNA, 1209 bp, Homo sapiens
  Payload ID: 11931
  Gene Symbol: OR56A4
  Gene Name: olfactory receptor, family 56, subfamily A, member 4
  Uniprot ID: Q8NGH8
  ENST ID: ENST00000330728
  CDS Start-End: 47-1144
cattgtggctggcatatgatacatacttggttaaatataagggaggatgatgacagtgattttaaaaactttattgggacagatacagggcctcagtggaaacccacactctactacgtctagaatgtactttttatgtttctgtacttctctactacgttttaaggtacactgggtctccagattgatcaggaaactttacatggcatctcccagcaatgactccactgccccagtctctgaattcctcctcatctgcttccccaacttccagagctggcagcactggttgtctctgcccctcagccttctcttcctcctggccatgggagctaacaccaccctcctgatcaccatccagctggaggcctctctgcaccagcccctgtactacctgctcagcctcctctccctgctggacatcgtgctctgcctcaccgtcatccccaaggtcctggccatcttctggtttgacctcaggtcgatcagcttcccagcctgcttcctccagatgttcatcatgaacagttttttgaccatggagtcctgcacgttcatggtcatggcctatgaccgttatgtggccatctgccatccattgagatacccgtctatcatcactgaccagtttgtggctagggccgtggtctttgttatagcccggaatgcctttgtttctcttcctgttcccatgctttctgccaggctcagatactgtgcaggaaacataatcaagaactgcatctgcagtaacctgtctgtgtccaaactctcttgtgatgacatcactttcaatcagctctaccagtttgtggcaggctggactctgttgggctctgatcttatccttattgttatctcctattcttttatattgaaagttgtgcttaggatcaaggccgagggtgctgtggccaaggccttgagcacgtgtggttcccacttcatcctcatcctcttcttcagcacagtcctgctggttctggtcatcactaacctggccaggaagagaattcctccagatgtccccatcctgctcaacatcctgcaccacctcattcccccagctctgaaccccattgtttatggtgtgagaaccaaggagatcaagcagggaatccaaaacctgctgaagaggttgtaagaataaaaaggattagatccacctttagagttgttaattgttagtgaaaattgggaaatagggaa

SEQ ID NO: 162428 - DNA, 738 bp, Homo sapiens
  Payload ID: 11932
  Gene Symbol: OR56A5
  Gene Name: olfactory receptor, family 56, subfamily A, member 5
  ENST ID: ENST00000340110
  CDS Start-End: 1-738
ctctccctgctggacatcgtactctgcctcaccgtcatccccaaggtcctggccatcttctggtttgacctcagatcaatcagcttccctgcctgcttccttcaggtgttcatcatgaacagttttctgactatggagtcctgcacattcatgatcatggcctatgaccgctatgtggccatctgcaagcccctacagtactcatccatcatcactgatcaatttgtcgctagggctgccatctttgttgtggccaggaatggccttcttactatgcctatccccatactttcttctcgactcagatactgtgcaggacacatcatcaagaactgcatctgtactaacgtgtctgtgtctaaactctcttgtgatgacatcaccttgaatcagagctaccagtttgttataggttggaccctgctgggctctgacctcatccttattgttctctcttacttttttatcttgaaaactgtgctaaggattaagggtgagggagatatggccaaagctctaggtacttgtggttcccacttcatcctcatcctcttcttcaccacagtcctgctggttctggtcatcactaacctggccaggaagagaattcctccggatgtccccatcctgctcaacatcctgcaccaccttattcccccagctctgaaccccattgtttatggtgtgagaaccaaggagatcaagcagggaatccagaacctgctgaggaggttatgt

SEQ ID NO: 162429 - DNA, 942 bp, Homo sapiens
  Payload ID: 11932
  Gene Symbol: OR56A5
  Gene Name: olfactory receptor, family 56, subfamily A, member 5
  Uniprot ID: P0C7T3
  ENST ID: ENST00000532411
  CDS Start-End: 1-942
atgacattacccagcaacaactccacttccccagtctttgaattcttcctcatttgtttccccagtttccagagctggcagcactggctgtctctgcccctcagcctcctcttcctcctggccatgggggccaatgccacccttctgatcaccatctatctggaagcctctctgcaccagcccctgtactacctgctcagcctcctctccctgctggacatcgtactctgcctcaccgtcatccccaaggtcctggccatcttctggtttgacctcagatcaatcagcttccctgcctgcttccttcaggtgttcatcatgaacagttttctgactatggagtcctgcacattcatgatcatggcctatgaccgctatgtggccatctgcaagcccctacagtactcatccatcatcactgatcaatttgtcgctagggctgccatctttgttgtggccaggaatggccttcttactatgcctatccccatactttcttctcgactcagatactgtgcaggacacatcatcaagaactgcatctgtactaacgtgtctgtgtctaaactctcttgtgatgacatcaccttgaatcagagctaccagtttgttataggttggaccctgctgggctctgacctcatccttattgttctctcttacttttttatcttgaaaactgtgctaaggattaagggtgagggagatatggccaaagctctaggtacttgtggttcccacttcatcctcatcctcttcttcaccacagtcctgctggttctggtcatcactaacctggccaggaagagaattcctccggatgtccccatcctgctcaacatcctgcaccaccttattcccccagctctgaaccccattgtttatggtgtgagaaccaaggagatcaagcagggaatccagaacctgctgaggaggttgtaa

SEQ ID NO: 162430 - DNA, 975 bp, Homo sapiens
  Payload ID: 11933
  Gene Symbol: OR56B1
  Gene Name: olfactory receptor, family 56, subfamily B, member 1
  Uniprot ID: Q8NGI3
  ENST ID: ENST00000317121
  CDS Start-End: 1-975
atgaatcatatgtctgcatctctcaaaatctccaatagctccaaattccaggtctctgagttcatcctgctgggattcccgggcattcacagctggcaacactggctatctctgcccctggcactactgtatctctcagcacttgctgcaaacaccctcatcctcatcatcatctggcagaacccttctttacagcagcccatgtatattttccttggcatcctctgtatggtagacatgggtctggccactactatcatccctaagatcctggccatcttctggtttgatgccaaggttattagcctccctgagtgctttgctcagatttatgccattcacttctttgtgggcatggagtctggtatcctactctgcatggcttttgatagatatgtggctatttgtcaccctcttcgctatccatcaattgtcaccagttccttaatcttaaaagctaccctgttcatggtgctgagaaatggcttatttgtcactccagtgcctgtgcttgcagcacagcgtgattattgctccaagaatgaaattgaacactgcctgtgctctaaccttggggtcacaagcctggcttgtgatgacaggaggccaaacagcatttgccagttggttctggcatggcttggaatggggagtgatctaagtcttattatactgtcatatattttgattctgtactctgtacttagactgaactcagctgaagctgcagccaaggccctgagcacttgtagttcacatctcaccctcatccttttcttttacactattgttgtagtgatttcagtgactcatctgacagagatgaaggctactttgattccagttctacttaatgtgttgcacaacatcatccccccttccctcaaccctacagtttatgcacttcagaccaaagaacttagggcagccttccaaaaggtgctgtttgcccttacaaaagaaataagatcttag

SEQ ID NO: 162431 - DNA, 1152 bp, Homo sapiens
  Payload ID: 11934
  Gene Symbol: OR56B4
  Gene Name: olfactory receptor, family 56, subfamily B, member 4
  Uniprot ID: Q8NH76
  ENST ID: ENST00000316529
  CDS Start-End: 96-1055
acaggcatgaaccacgatgctcagccccttagctgaacttttaaacagagatttcttctatttcagacagacactgagactgaggcacccattccatggatacctccaccagtgttacctatgactccagcctccagatttcccagttcatcctgatgggattaccaggcattcatgagtggcagcactggctctccctgcccctgactctgctctacctcttagctcttggtgccaatctcctcatcataatcaccattcaacatgagaccgtgctacatgaacccatgtaccatttgctgggcatattagcagtggtggacattggcctggccaccaccatcatgcccaagatcctggccatcttctggtttgatgccaaggccattagcctccccatgtgttttgctcagatctatgccatccactgcttcttctgcatagagtcaggcatctttctctgcatggcagtagacagatacatagccatctgtcgccctcttcagtacccctccatagtcactaaagcttttgtcttcaaagccacagggttcatcatgctcaggaatggcctgttgaccatcccagtgcctatactggctgcccagagacactactgttccaggaatgaaatcgagcactgcctctgctctaacttgggggttatcagcctggcttgtgatgacatcactgtgaacaaattttaccaactgatgctagcatgggtcttggttgggagtgatatggctctggtattttcttcctatgctgtaatccttcactctgtgctgaggctgaactcagcagaagcaatgtccaaggctctgagcacttgtagctcccacctcatcctcatcctcttccacacaggtatcattgtgctgtctgtcacacaccttgcagagaaaaagattccccttattcctgtgttccttaatgtgctgcacaatgtcatcccccctgcactcaaccccctggcctgtgcactcaggatgcacaaactcagactgggctttcagagactgcttggactgggtcaggacgtgtccaagtaactccagctttaggaatccagtaagatgttaggaaatgacagaggttttagttctcaatagatcagggttataatctgcacttaccacactccctagg

SEQ ID NO: 162432 - DNA, 1157 bp, Homo sapiens
  Payload ID: 11935
  Gene Symbol: OR6A2
  Gene Name: olfactory receptor, family 6, subfamily A, member 2
  Uniprot ID: O95222
  ENST ID: ENST00000332601
  CDS Start-End: 76-1059
ggctgggttcttgttgtggcctactgaagactctctactctcatctcctgaagagcagtaagagagaccaatgacatggagtggcggaaccatagtgggagagtgagtgagtttgtgttgctgggcttccctgctcctgcgccactacaggtactattgtttgcccttttgctgctggcctatgtgttggtgctgactgagaacacactcatcattatggcaattaggaaccattctaccctccacaaacccatgtacttttttctagctaatatgtcctttctggagatctggtatgtcactgtcactattcccaagatgcttgctggctttgttggatccaaacaggatcatggacagctaatctcctttgagggatgcatgacacagctctactttttccttggcttgggctgcactgagtgtgtccttctcgctgttatggcctatgatcgctatatggccatctgctatcctctccactacccagtcattgtcagtggccggctgtgtgtgcagatggctgctggctcttgggctggaggttttggcatctccatggtcaaagtttttcttatttctggcctctcttactgtggccccaacatcatcaaccactttttctgtgatgtctctccattgctcaacctctcatgcactgatatgtccacagcagagcttacagatttcatcctggccatttttattcttctagggccactctctgtcactggggcctcctatgtggccattactggtgctgtgatgcacattccttcggctgctggacgctataaggccttttccacctgtgcctctcatctcactgttgtgataatcttctatgcagccagtatcttcatctatgctcggccaaaggcactctcagcttttgacaccaacaagttggtctctgtactgtatgctgtcattgtaccattgctcaatcccatcatttactgcctgcgcaatcaagaggtcaagagagccctatgctgtactctgcacctgtaccagcaccaggatcctgaccccaagaaagctagcagaaatgtatagaagggatgtgtgaaatctgataaaatgctattaaacttgggatcaatgtgttctatgaagtccagtggagttcttagggcctaaattgggggccagag

SEQ ID NO: 162433 - DNA, 1055 bp, Homo sapiens
  Payload ID: 11936
  Gene Symbol: OR6B1
  Gene Name: olfactory receptor, family 6, subfamily B, member 1
  Uniprot ID: O95007
  ENST ID: ENST00000408922
  CDS Start-End: 69-1004
tagctgggccatggagtctgatcaaatgatttttcctccccaggagagctaagccctgtgtctccaatatggagttggagaaccagacacgagtcaccaagttcattctggtgggattccctgggagcttgagtatgcgggcagccatgtttctgatattccttgtggcctatattctgacagtggctgaaaacgtgatcatcatcctattggtgctgcaaaatcggccactgcacaagcctatgtacttcttcctggccaacctgtccttcttggagacctggtacatctctgtgactgtgcccaagttactgtttagtttttggtctgtgaacaacagcatctctttcacactctgtatgatacaactgtacttcttcattgctctcatgtgcacagaatgtgtgcttctggccgccatggcctatgaccggtatgtggccatctgtcgcccactccactacccaaccataatgagccatgggctctgcttccgcctcgctcttggttcctgggccattggctttggcatctccctggcgaagatctacttcatctcctgcctcagcttctgtggtcccaatgtcatcaaccacttcttctgtgacatctctccagtacttaatctctcctgcacagacatgtccataactgagttggtagactttatcctggcactggtcatcttcctattcccactctttattactgtcctgtcctacggatgcattctggccaccatattatgcatgcccacaggaaagcagaaagcgttctccacttgtgcctcccatcttgtggtggtcaccattttctattcagccattattttcatgtatgctcgacctcgagttatccatgccttcaacatgaacaaaattatttccatcttctatgccattgtcactccttctctcaaccctttcatttattgcctaagaaaccgagaggtcaaggaagctctgaagaaactggcatattgccaggccagcagatctgactagtcaattacagctgattagaaagaaaggtctgagtgggtgcctgtatgtctt

SEQ ID NO: 162434 - DNA, 1492 bp, Homo sapiens
  Payload ID: 11937
  Gene Symbol: OR6B2
  Gene Name: olfactory receptor, family 6, subfamily B, member 2
  Uniprot ID: Q6IFH4
  ENST ID: ENST00000402971
  CDS Start-End: 28-966
aggcctgcagctcccaagcacagaggcatgagtggggagaatgtcaccaaggtcagcaccttcatcctggtgggcctccccacggccccagggctgcagtacctgctcttcctcctcttcctgctcacctacctctttgtcctggtggagaacctggccatcatcctcatcgtctggagcagcacctccctccacaggcccatgtactactttctgagctccatgtctttcctggagatctggtacgtgtctgacatcacccccaagatgctggagggcttcctcctccagcagaaacgcatctctttcgtcgggtgcatgacgcagctctacttcttcagctccctggtgtgcaccgagtgtgtgcttctggcctccatggcctacgaccgctacgtggccatctgccacccgctgcgctaccacgtccttgtgaccccggggctgtgcctccagctggtgggcttctcctttgtgagtggcttcaccatctccatgatcaaggtctgttttatctccagcgtcacgttctgtggctccaacgtcttgaaccacttcttctgtgacatttcccccatcctcaagctggcctgcacggacttctccactgcagagctggtggatttcatcctggccttcatcatcctggtgtttccgctcctggccaccatactgtcatattggcacatcaccctggctgtcctgcgcatcccctcggccaccggctgctggagagccttctctacctgcgcctctcacctcaccgtggtcaccgtcttctatacagccttgcttttcatgtatgtccggccccaagccattgattcccagagctccaacaagctcatctctgccgtgtacactgttgtcacgccaataattaaccctttgatttactgcctgaggaacaaggaatttaaggacgccttgaaaaaggccttgggcttgggtcaaacttcacactaagacaactaaatgtcctagagtaaaatctgtagtgatgaaacaacattgtatgtggcactttgtgctctttaaattaatttttaagttaaatttaacaaacctacagaactaagtgaaatttaacaaacctacacaactgtgcacaagtaacaagccttcgtctgcatatgttttcacaaaaggactgtgctcatggaaccagctcccagatcaagaactagaagctgccttcacgccctctcccagtcattaacccttctccacaaaaagcactgtcctgacttccaaaaccagatgctagcattggtgtttctgaggggcttacacataaagtatgtgccctgttatgttcagcttctttcattcaccgtgttgcttgagtgaatccttgatgtttttgcatgtaacaataattcatgcattctcattgctatccaatattcataataaataatacatttatactgtataatacacaatgcataatacattcatactgggataatacatatactgggataatgca

SEQ ID NO: 162435 - DNA, 996 bp, Homo sapiens
  Payload ID: 11938
  Gene Symbol: OR6B3
  Gene Name: olfactory receptor, family 6, subfamily B, member 3
  Uniprot ID: Q8NGW1
  ENST ID: ENST00000319423
  CDS Start-End: 1-996
atgagtggggagaatgtcaccagggtcggcaccttcatcctggtgggcttccccacggccccagggctgcagtacctgctcttcctcctcttcctgctcacctacctctttgtcctggtggagaacctggccatcatcctcaccgtctggagcagcacctccctccacaggcccatgtactactttctgagctccatgtctttcctagagatctggtacgtgtctgacatcacccccaagatgctggagggcttcctcctccagcagaaacgcatctctttcgtcgggtgcatgacgcagctctacttcttcagctccctggtgtgcaccgagtgtgtgcttctggcctccatggcctacgaccgctacgtggccatctgccacccgctgcgctaccacgtccttgtgaccccggggctgtgcctccagctggtgggcttctcctttgtgagtggcttcaccatctccatgatcaaggtctgttttatctccagcgtcacgttctgtggctccaacgtcttgaaccacttcttctgtgacatttcccccatcctcaagctggcctgcacggacttctccactgcagagctggtggatttcattctggccttcatcatcctggtgtttccactcctggccaccatgctgtcatatgcgcacatcaccctggctgtcctgcgcatcccctcggccaccggctgctggagagccttcttcacctgcgcctctcacctcaccgtggtcaccgtcttctatacagccttgcttttcatgtatgtccggccccaggccattgattcccggagctccaacaagctcatctctgttttgtacacagttatcacccccatcttgaaccccttgatatactgcctgaggaataaggaatttaagaatgccttgaaaaaagccttcggcttgacgagctgcgccgtagaggggaggctttctagtcttctggaacttcatctccaaatacacagccagcctctctga

SEQ ID NO: 162436 - DNA, 1064 bp, Homo sapiens
  Payload ID: 11939
  Gene Symbol: OR6C1
  Gene Name: olfactory receptor, family 6, subfamily C, member 1
  Uniprot ID: Q96RD1
  ENST ID: ENST00000379668
  CDS Start-End: 40-978
ttgtaggtctggcaggggaaaaaagaaagcaactgaagaatgagaaaccatacagaaataacagagtttattcttctgggattaacagatgacccaaattttcaggttgtaatctttgtcttcctgctcatcacctacatgctcagcatcactgggaacctgacccttatcacaattaccctgctggattcccacctgcagacccccatgtatttcttcctcagaaatttctccatattagaaatttcgttcacaaccgtcagtatacccaagtttctgggtaacattatttcaggagataaaaccatttcctttaataattgcatagttcagttatttttcttcattctcttgggagtcacagagttttaccttctggctgccatgtcctatgaccgctatgtggccatctgcaagcctctgcattgcttgagtatcatgaatcgaagagtctgcacactgcttgtttttacttcttggctggtttcattcttaatcatattcccagcactcatgttgcttttaaagcttcattactgtaggtctaatattattgaccattttacctgtgattattttccactgctgcaacttgcttgttcagacacaaaattcttagaggtgatgggattttcttgtgctgcgtttactctaatgttcactttggcattaatatttctgtcctacatatacattatcagaacaattttgagaattccttctactagtcagaggacaaaggccttttccacatgttcttcccacatggttgttgtctccatctcttatggcagctgcatttttatgtacattaaaccctcagcaaaagatagagtgtccttgagcaagggagtggcaatactaaacacctcagtagcccccatgatgaacccctttatttacagcctaagaaatcagcaagtcaagcaagctttcattaacatggcaaggaagactgtatttttcacaagcacatgaaatggtatggtgtgatgaattagaggcacaggaaaggacaatatgaattttcagtagcttcttcaatcaaaatggcctccttgcag

SEQ ID NO: 162437 - DNA, 939 bp, Homo sapiens
  Payload ID: 11940
  Gene Symbol: OR6C2
  Gene Name: olfactory receptor, family 6, subfamily C, member 2
  Uniprot ID: Q9NZP2
  ENST ID: ENST00000322678
  CDS Start-End: 1-939
atgaaaaaccacacagtaataagaacttttatcctgctgggactgacaggtgacccacacctgcaagttctgctttttatctttctatttctcacctacatgttgagtgtaacagggaacctgactattatcaccctcacattggtggaccaccaccttaaaactcctatgtacttctttctcagaaatttttccttcttagaagtctcatttactacagtctgcattcccagattcttgtacaatatatcaatgggggacaataccattacctacaatgcttgtgccagtcaaatattctttgttattctctttggagcaacagaattttttctcttggcagccatgtcctatgaccgctatgtggccatctgtaaaccccttcattatgtggtcatcatgaacaacagggtgtgtaccttattagttctctgctgttgggtggctggcttgatgatcattgttccaccacttagcttaggcctccagctcgaattctgtgactccaatgccattgatcattttagctgtgatgcaggtcctctcctaaagatctcatgctcagatacatgggtaatagaacagatggttatacttatggctgtatttgcactcattatcaccctagtttgtgtgattctgtcctacttgtacatagtcagaacaattctgaagttcccttctgttcagcaaaggaaaaaggccttttctacctgttcatcccacatgattgtggtttccattgcctatggaagctgcatcttcatctatatcaagccctctgcaaaagatgaggtggccataaataaaggagtttcagttcttactacttctgtcgcacccttgttgaaccccttcatttacaccttgaggaacaagcaagtgaaacaagctttcagtgactctataaagaggattgcatttctctcaaagaagtag

SEQ ID NO: 162438 - DNA, 936 bp, Homo sapiens
  Payload ID: 11941
  Gene Symbol: OR6C3
  Gene Name: olfactory receptor, family 6, subfamily C, member 3
  Uniprot ID: Q9NZP0
  ENST ID: ENST00000379667
  CDS Start-End: 1-936
atgaaccacacaatggtcacagagtttgtcctcctgggcctttctgatgatcctgaccttcagattgtgatttttctctttttatttatcacgtatatattaagtgttactggaaacctgactatcatcaccctaacctttgtggactcccatctgcagacacctatgtatttcttcctccggaacttctctttcttagaaatctcatttacaaccgtatgcatccccagatttctgggggcaattatcaccaggaataagactatttcctataacaactgtgcagcccaactctttttctttatcttcatgggggtgactgaattttacattttaactgccatgtcctatgaccgctatgttgccatctgcaagccccttcattacacatccatcatgaacaggaaactctgcactctacttgtgctgtgtgcctggctaagtgggtttctgaccattttcccaccccttatgcttctcctccagctggattactgtgcttccaacgtcattgatcactttgcatgtgactattttcccctcttacaactatcttgttcagatacatggctcctagaagtaattggtttttactttgctttggttactttgctgttcactttggcattagtgattttatcttacatgtacattatcaggaccattttgagaatcccgtctgccagtcaaagaaaaaaggctttctccacttgttcttctcacatgattgtcatttccatttcttatggaagctgtatattcatgtatgctaatccatctgcaaaagaaaaggcatcattgacaaaaggaatagctattctcaatacatctgttgcccccatgctgaaccccttcatttacactctgagaaaccagcaagtaaaacaagccttcaaaaatgtggtccacaaagttgtgttttatgcaaatcaatga

SEQ ID NO: 162439 - DNA, 1046 bp, Homo sapiens
  Payload ID: 11942
  Gene Symbol: OR6C4
  Gene Name: olfactory receptor, family 6, subfamily C, member 4
  Uniprot ID: Q8NGE1
  ENST ID: ENST00000394256
  CDS Start-End: 29-958
ttgcctttaggttttccgaaggtcaacaatgaaaaacagaaccatgtttggtgagtttattctactgggccttacaaatcaacctgaactccaagtgatgatattcatctttctgttcctcacctacatgctaagtatcctaggaaatctgactattatcaccctcaccttactagacccccacctccagacccccatgtatttcttcctccggaatttctccttcttagaaatttccttcacatccatttttattcccagatttctgaccagcatgacaacaggaaataaagttatcagctttgctggctgcttgactcagtatttttttgctatatttcttggagctaccgagttttacctcctggcctccatgtcttatgatcgttatgtggccatctgcaaacccttgcattacctgactattatgagcagcagagtctgcatacaactagtgttctgctcctggttggggggattcctagcaatcttaccaccaatcatcctgatgacccaggtagatttctgtgtctccaacattctgaatcactattactgtgactatgggcctctcgtggagcttgcctgctcagacacaagcctcttagaactgatggtcatcctcttggccgttgtgactctcatggttactctggtgctggtgacactttcttacacatacattatcaggactattctgaggatcccttctgcccagcaaaggacaaaggccttttccacttgttcctcccacatgattgtcatctccctctcttatggcagctgcatgtttatgtacattaatccttctgcaaaagaaggaggtgctttcaacaaaggaatagctgtactcattacttcggttactcccttactgaatcccttcatatatactttaagaaatcagcaagtgaaacaagctttcaaggactcagtcaaaaagattgtgaaactttaaaaaaggagattacacttcaaaatacattttcacttaacaaatatgcattgaatgtctatatttcaagtgctaaattggcccttgaaga

SEQ ID NO: 162440 - DNA, 945 bp, Homo sapiens
  Payload ID: 11943
  Gene Symbol: OR6C6
  Gene Name: olfactory receptor, family 6, subfamily C, member 6
  Uniprot ID: A6NF89
  ENST ID: ENST00000358433
  CDS Start-End: 1-945
atgaagaacaaatcaatggaaatagagttcattctcctaggattgacagatgacccacagttgcaaattgtgattttcctgtttctatttctcaactacaccttgagcctgatggggaacttaatcatcatcatcctcaccctgctggatccccggctcaagacgccaatgtatttctttctccgtaatttctcctttttggaagtaatattcacaacagtgtgtattcctagattcttgataaccattgtgactagagacaaaaccatttcttataataattgtgcaactcaattattttttatccttttaccgggagttactgagttttacctcctggctgccatgtcctatgaccgctacgttgccatctgcaaaccactgcattatccaatcattatgagcagcaaagtctgctaccaacttgtacttagctcttgggtaactggattcttaatcatatttcccccattggtcatgggactcaagctggatttttgtgcttccaaaactattgaccactttatgtgtgaaacttctcctattctgcagatctcctgcacagatacccatgtcctagaattgatgtcttttaccttagctgtggtgacacttgtggtcacactggtattagtgattctctcttacacttgcattattaagaccattctgaaattctcttctgcacagcaaaggaacaaagcattttccacctgtacttcccacatgattgttgtctccatgacatacggtagctgtatctttatgtatattaaaccatctgcaaaagaaagagtgactgtatccaaaggtgtagctttgctctatacctcaattgcccctttactaaatcccttcatttatactctcagaaaccagcaggtgaaagaagtcttctgggatgtattacaaaagaatttgtgtttttctaaaagaccattttaa

SEQ ID NO: 162441 - DNA, 1076 bp, Homo sapiens
  Payload ID: 11944
  Gene Symbol: OR6C65
  Gene Name: olfactory receptor, family 6, subfamily C, member 65
  Uniprot ID: A6NJZ3
  ENST ID: ENST00000379665
  CDS Start-End: 100-1038
tgcagaataagagcaatcctagtgtatttgaaatcaaatcacgtattgacattcactcttctttttatctacagacctatcagaattcagaactaagccatgccaaatatgacatcaattagagaattcattcttctgggatttacagataacccagagttacaagttgtgatattcttctttatgttgatcacatacttattgagtgtaagtggaaacatgatcatcattatgttaacattgtcaaatattcatttgaaaactcctatgtatttcttcctcaggaatttctctttcttagaaatttcatttacgacagtcttcattcctagatttctgatcaacattgctacaggagacacaaccatttcctataatgcttccatggcccaagtattttttttaattcttttgggatcaacagaattttttcttctggctgtcatgtcttatgatcgctatgtggctatctgcaaacctctacattatacaaccatcatgagtaacaaagtctgtaattggcttgtaatcagctcctggctggctggttttctcattatttttccccccgtgattatgggcctccaactggatttttgtgactccagcactattgaccatttcatctgtgattcttcccctatgctgctgattgcttgcacagacacacagtttctagagcttatggcatttttgctagcagtattcacactcatggtaactttggccttggtggttctctcctacacactcatccttaaaacaattctgaagattccctctgcccagcaaaggaaaaaggctttttcaacttgttcctcccatatgattgtggtttctgtttcttatgggagttgcatttttatgtgtgtaaaaacatctgcaaaagaaggtatggctttgagcaaaggtgtagcagtgcttaatacctctgttgctcctatgttgaatccctttatttataccttaagaaaccagcaggtgaaacaggcccttagggaattcaccaaaaaaatattatcattgaacaagcaataatgataactaaatctgtggctgaaacacaaataagccaa

SEQ ID NO: 162442 - DNA, 939 bp, Homo sapiens
  Payload ID: 11945
  Gene Symbol: OR6C68
  Gene Name: olfactory receptor, family 6, subfamily C, member 68
  Uniprot ID: A6NDL8
  ENST ID: ENST00000548615
  CDS Start-End: 1-939
atgagaaaacacacagcaataacaacattcatccttctgggactgacagaagatcctcagctgcaggttctgcttttcatgtttctatttatcacctacatgttgagtgtaacagggaaactgaccattatcgccctcaccatgttggatccccacctgaaaacacccatgtatttttttctccaaaatttatctttcttagaaatctcatttacagctacctgtgttccaagattcttatacagtatctcaactgggaacaaaataataacgtataatgcatgtgtcattcagctattttttgcagacctctttggggtaactgaattttttcttttggctaccatgtcatatgatcgctatgtggccatctgcaaacccttgcattatatggcaatcatgagcaacaaagtgtgcaaaacaatggttatttgttgttggatggcagcacttatgattatcctcccaccacttagcttaggttttcatctagaattctgtgactctaatgtcatcaatcattttggctgtgatgcattgcctattctgaaaataccatgctcagacacatcattaattgagcagatggttgtagcctctgctgtattaacctttattatcactcttgtatgtgtagttctgtcctacacatatatcataagaacaattctaaaattcccttctgttcaacaaaagaaaaaagccttttctacctgttcttcacatattactgtggtttccatcacttatggcagctgcatcttcatctatatcaagccatctgcaaaagaagaggtaaacattaataaaggtgtgtcagtgcttatttcatccatatcacctatgttgaattctttcatatatactcttaggaatgagcaagttaaacaagcctttcatgactcactcaaaaaaattgcatttcgtttaaaaaagtaa

SEQ ID NO: 162443 - DNA, 939 bp, Homo sapiens
  Payload ID: 11946
  Gene Symbol: OR6C70
  Gene Name: olfactory receptor, family 6, subfamily C, member 70
  Uniprot ID: A6NIJ9
  ENST ID: ENST00000327335
  CDS Start-End: 1-939
atgaagaatcatacaaggcagatagaatttattcttctgggactgacggataattctcagttacagattgtaattttcttatttctacttctaaattgtgtgttgagcatgatagggaacttcactatcattgccctcattctgctggattcccagctcaagactccaatgtatttcttcctccgtaatttctcttttctggaaatttcattcacaactgcttgcattcccagattcctaatcaccattgttaccagggaaaagaccatttcctgtaatggttgcatatctcagttgtttttttacatattcttgggggttacagaatttttccttctagctgctctgtcctatgatcgctatgttgccatctgcaaacctttgcgttatatgtccatcatgagtaacaaagtttgctaccagcttgtattcagttcttgggtaactggattcctgatcattttcactccactgattttaggtcttaacttggatttctgtgcttcaaatatcattgatcatttcatttgtgacatttctcttatcctacaactttcttgctcagacacacatttactggaactgattgcctttttattagctgtgatgacacttattgtcacattgtttttagtaatcctttcttactcttacatcatcaagacaattctgaaattcccttcagctcagcaaaagaagaaagccttttccacctgctcttctcacatgattgttgtctccatcacttatggtagttgtatgtttatctacataaagccatcagcgaatgaaagagttgctttaagcaaaggagtaactgtgctcaatacttcagttgccccgttgttaaacccatttatttatactctgaggaatcagcaagttaaacaagccttcaaagctgtatttagaaagatattttctgcttcagacaagtaa

SEQ ID NO: 162444 - DNA, 1105 bp, Homo sapiens
  Payload ID: 11947
  Gene Symbol: OR6C74
  Gene Name: olfactory receptor, family 6, subfamily C, member 74
  Uniprot ID: A6NCV1
  ENST ID: ENST00000343870
  CDS Start-End: 91-1029
tggtggatttcaagaaaaatgggtatctcatgcagacctttcctcttctgttctaatttttcttcttatttttaaaaatagaaatcaactatgagaaaccatacaacagtagcaaactttattcttcttggactgacagatgatccacaattacaggtgattatttttcttctcctttttttcacctacatgttgagcatcactgggaatctaaccatcatcactctcaccctactggatttgcatctcaagacacccatgtatttcttcctccgaaatttctcatttttagaagtctcattcacaactgtctacattcccaaatttcttgttagtatggcaacaggtgataagaccatttcttacaacgattgtgcagcacagctgtttttcactattctcttgggggcaactgaattttttcttctggctgccatgtcctatgagcgctatgtggccatctgcaaacccctgcattacaccaccatcatgagcagcagagtttgcagcttgctggtctttgcttcatggatggctggcttcctaataatttttccgccactcctgatgggtctccagcttgatttctgtgcagccaacactgtagatcatttcttctgtgatgtttctcctatactgcagctctcttgcacagacactgacataatagaattaatgatgcttctctcagccattttgacgctcctggttacactggtattagtgattctctcctacacaaatattatcaggactattctgaaaataccttcttctcaacagagaaaaaaagcattttctacatgttcttcccacatggtggtcgtgtccatttcttatggcagctgcatcttcatgtatgtgaaaccctcagcaaaagaaagagtgtcattaaataaagggatagctctgctcagcacttctgttgcccccatgttgaatccctttatttatacactgagaaacaaacaagtaaaagatgtttttaagcacacagtcaaaaagattgaacttttctcaatgaaatgaatcactttaacgatattattaaggttattagtaaaataaaacaagaagagtggagtatgtgcaaagtttttcaatg

SEQ ID NO: 162445 - DNA, 939 bp, Homo sapiens
  Payload ID: 11948
  Gene Symbol: OR6C75
  Gene Name: olfactory receptor, family 6, subfamily C, member 75
  Uniprot ID: A6NL08
  ENST ID: ENST00000343399
  CDS Start-End: 1-939
atgagaaattccacagcagtaacagactttattcttcttggattgacaagtgacccacagtggcaggttgtacttttcatatttcttcttgttacctacatgttaagtgtgactgggaacctgatcattatcaccctcaccctttcagatccccatctgcagactcccatgtatttcttccttcggaacttctcattcctggaaatttcattcacgtctgtctgcattcccagattccttgtcactgttgtgacaggaaacagaaccatttcttataatgggtgtgtggctcagctattttttttcatcttcttgggggtgacagaattttaccttctggctgccatgtcctatgaccgctgcatggccatctgcaaacctcttcattacacaatcatcatgagcaccagagtgtgtacccttcttgtctttagctcctggcttgcagggtttctgatcatctttccaccagtaatgcttctgctgcagttggatttctgtgcctccaatgtaattgatcattttatctgtgactcttctccaatgctgcagctctcttgcacaaacactcactttctagaactcatggcattttttttagctgtggtaacactgatggtcaccttgacattagttattctctcctacacaaacatcatccggacaattctgaaaattccttctatgagtcaaaggaaaaaagccttttccacttgctcctcccatatgatagttgtctccatctcttacagtagctgtatcttcatgtacattaagacttctgccagagaaagggtgactttaagcaaaggagtagctgtgctcaatacctcagtggctcctctcttgaatcccttcatatacacactgagaaataagcaagtgaagcaagccttcaagagcatggtccagaagatgattttttctttaaataaatga

SEQ ID NO: 162446 - DNA, 939 bp, Homo sapiens
  Payload ID: 11949
  Gene Symbol: OR6C76
  Gene Name: olfactory receptor, family 6, subfamily C, member 76
  Uniprot ID: A6NM76
  ENST ID: ENST00000328314
  CDS Start-End: 1-939
atgaaaaatagaacatcagtgacagatttcatccttctgggtctgacggataatccgcaactgcaggttgtgattttctcgttcctatttcttacgtatgtactgagtgttactggaaatctaactatcatctcccttaccctgctggattcccacctgaagacccccatgtatttcttcctcaggaatttctccttggaaatttcatttacttctgtctgtaatcctagatttctgatcagcattctaacaggggacaaatccatatcttataatgcttgtgcagctcagctatttttctttatcttccttggctcaacggagtttttcctcctggcctctatgtcctatgattgctatgtggctatatgtaagcctctgcattatacaaccatcatgagtgacaggatctgttatcagcttataatcagctcttggctggctggtttcttggtaatttttccaccactggccatgggcttacagctggatttctgtgactccaatgtcattgaccactttacctgtgactctgctcctttgctgcaaatctcttgcacagacacaagtactctagagctcatgagctttattttagctctgtttactcttatatccactttgatattagtaattctctcctatacttacatcatcagaactattctgagaatcccctcagcacagcaaagaaaaaaagccttttcaacctgctcctcacatgtgattgttgtctctatctcttatggaagctgcatcttcatgtatgtgaaaacatcagcaaaggaaggagttgctttgacaaaaggagtagctatactcaatacctctgtcgctcctatgctgaatccatttatttacactctaagaaaccagcaggtgaaacaagcatttaaggatgttctgagaaagatttcccacaaaaaaaaaaaacactga

SEQ ID NO: 162447 - DNA, 927 bp, Homo sapiens
  Payload ID: 11950
  Gene Symbol: OR6F1
  Gene Name: olfactory receptor, family 6, subfamily F, member 1
  Uniprot ID: Q8NGZ6
  ENST ID: ENST00000302084
  CDS Start-End: 1-927
atggacacaggcaacaaaactctgccccaggactttctcttactgggctttcctggttctcaaactcttcagctctctctctttatgctttttctggtgatgtacatcctcacagttagtggtaatgtggctatcttgatgttggtgagcacctcccatcagttgcatacccccatgtacttctttctgagcaacctctccttcctggagatttggtataccacagcagcagtgcccaaagcactggccatcctactggggagaagtcagaccatatcatttacaagctgtcttttgcagatgtactttgttttctcattaggctgcacagagtacttcctcctggcagccatggcttatgaccgctgtcttgccatctgctatcctttacactacggagccatcatgagtagcctgctctcagcgcagctggccctgggctcctgggtgtgtggtttcgtggccattgcagtgcccacagccctcatcagtggcctgtccttctgtggcccccgtgccatcaaccacttcttctgtgacattgcaccctggattgccctggcctgcaccaacacacaggcagtagagcttgtggcctttgtgattgctgttgtggttatcctgagttcatgcctcatcacctttgtctcctatgtgtacatcatcagcaccatcctcaggatcccctctgccagtggccggagcaaagccttctccacgtgctcctcgcatctcaccgtggtgctcatttggtatgggtccacagttttccttcacgtccgcacctctatcaaagatgccttggatctgatcaaagctgtccacgtcctgaacactgtggtgactccagttttaaaccccttcatctatacgcttcgtaataaggaagtaagagagactctgctgaagaaatggaagggaaaataa

SEQ ID NO: 162448 - DNA, 1044 bp, Homo sapiens
  Payload ID: 11951
  Gene Symbol: OR6J1
  Gene Name: olfactory receptor, family 6, subfamily J, member 1 (gene/pseudogene)
  Uniprot ID: Q8NGC5
  ENST ID: ENST00000540461
  CDS Start-End: 1-1044
atgggtaactggactgcagcggtgactgagtttgttctgctggggttttccctgagcagggaggtggagctgctgctcctggtgctcctgctgcccacgttcctgctgactcttctggggaacctgctcatcatctccactgtgctgtcctgctcccgcctccacacccccatgtacttcttcttgtgcaacctctctatcctggacatcctcttcacctcagtcatctctccaaaagtgttggccaacttaggatctagggataaaaccatctcctttgccggatgtatcacccagtgctatttctactttttcttgggcacagttgagttcctcctgctgacggtcatgtcctatgaccgttatgccaccatctgctgccccctgcggtacaccaccatcatgagaccttctgtctgcattgggaccgttgtattctcttgggtgggaggcttcctgtctgtgctctttccaaccatcctcatctcccagctgcccttctgtggctccaatatcattaaccacttcttctgtgacagtggacccttgctggccctggcctgtgcagacaccactgccatcgagctgatggattttatgctttcttccatggtcatcctctgctgcatagtcctcgtggcctattcctatacgtacatcatcttgaccatagtgcgcattccttctgcaagtggaaggaagaaggcctttaatacctgtgcttcccacctgaccatagtcatcatttctagtggcatcactgtgtttatctatgtgactccctcccagaaagaatatctggagatcaacaagatccctttggttctgagcagtgtggtgactccattcctcaacccctttatatatactctgaggaatgacacagtgcagggagtcctcagggatgtgtgggtcagggttcgaggagtttttgaaaagaggatgagggcagtgctgagaagcagattatcctccaacaaagaccaccaaggaagggcttgctcttctccaccatgtgtctattctgtaaagctccagtgttag

SEQ ID NO: 162449 - DNA, 975 bp, Homo sapiens
  Payload ID: 11952
  Gene Symbol: OR6K2
  Gene Name: olfactory receptor, family 6, subfamily K, member 2
  Uniprot ID: Q8NGY2
  ENST ID: ENST00000359610
  CDS Start-End: 1-975
atggagagccccaatcgaaccaccattcaggagtttatcttctccgctttcccttattcctgggttaagtctgttgtctgctttgttccactgctcttcatctatgctttcattgttgttggaaacctggtcatcatcacagtggtccagttgaatactcacctccacactcccatgtatacttttatcagtgctctttctttcctggagatttggtataccacagccacaatcccaaagatgctgtctagcctgcttagtgagaggagcatttccttcaatggttgtctcctgcagatgtatttcttccattccaccggcatctgtgaggtgtgtctcttgacagttatggcctttgaccactacctggccatatgcagccctcttcattatccctctatcatgacccccaagctatgtacccaactgactttaagttgctgtgtttgtggctttatcacaccccttcctgagattgcctggatctctacactgccattttgtggttcgaatcaccttgaacatatcttctgtgacttcctcccagtgctgcgtctggcctgcacagacacacgagccatcgtcatgattcaggtagtggatgtcattcatgcagtggagattattacagctgtgatgctcatcttcatgtcctacgatggtattgtggctgtaattctacgtattcattcagctggaggccgccgcacagcattttccacgtgtgtctctcacttcattgtcttttcgctcttctttggcagtgtgactctcatgtacctacgcttctctgccacctactctttgttctgggatatagccattgctctggcctttgcagttttgtctcccttcttcaaccccattatctatagcctgaggaataaagaaataaaagaagctataaaaaagcacataggtcaagctaagatatttttttccgtaagaccagggacctcaagtaagatattttag

SEQ ID NO: 162450 - DNA, 948 bp, Homo sapiens
  Payload ID: 11953
  Gene Symbol: OR6K3
  Gene Name: olfactory receptor, family 6, subfamily K, member 3
  ENST ID: ENST00000368145
  CDS Start-End: 1-948
atggagagcggaaaccaatcaacagtgactgaatttatcttcactggattccctcagcttcaggatggtagtctcctgtacttctttcctttacttttcatctatacttttattatcattgataacttattaatcttctctgctgtaaggctggacacccatctccacaaccccatgtataattttatcagtatattttcctttctggagatctggtacaccacagccaccattcccaagatgctctccaacctcatcagtgaaaagaaggccatctcaatgactggctgcatcttgcagatgtatttcttccactcacttgaaaactcagaggggatcttgctgaccaccatggccattgacagatacgttgccatctgcaaccctcttcgctatcaaatgatcatgaccccccggctctgtgctcaactctctgcaggttcctgcctcttcggtttccttatcctgcttcccgagattgtgatgatttccacactgcctttctgtgggcccaaccaaatccatcagatcttctgtgacttggtccctgtgctaagcctggcctgtacagacacgtccatgattctgattgaggatgtgattcatgctgtgaccatcatcattaccttcctaatcattgccctgtcctatgtaagaattgtcactgtgatattgaggattccctcttctgaagggaggcaaaaggctttttctacctgtgcaggccacctcatggtcttcccgatattctttggcagtgtatcactcatgtacttgcgtttcagcgacacttatccaccagttttggacacagccattgcactgatgtttactgtacttgctccattcttcaatcccatcatttatagcctgagaaacaaggacatgaacaatgcgattaaaaaactgttctgtcttcaaaaagtgttgaacaagcctggaggttaa

SEQ ID NO: 162451 - DNA, 996 bp, Homo sapiens
  Payload ID: 11953
  Gene Symbol: OR6K3
  Gene Name: olfactory receptor, family 6, subfamily K, member 3
  Uniprot ID: Q8NGY3
  ENST ID: ENST00000368146
  CDS Start-End: 1-996
atgtgctggactatgccctctccatttacaggtagctctactagaaatatggagagcggaaaccaatcaacagtgactgaatttatcttcactggattccctcagcttcaggatggtagtctcctgtacttctttcctttacttttcatctatacttttattatcattgataacttattaatcttctctgctgtaaggctggacacccatctccacaaccccatgtataattttatcagtatattttcctttctggagatctggtacaccacagccaccattcccaagatgctctccaacctcatcagtgaaaagaaggccatctcaatgactggctgcatcttgcagatgtatttcttccactcacttgaaaactcagaggggatcttgctgaccaccatggccattgacagatacgttgccatctgcaaccctcttcgctatcaaatgatcatgaccccccggctctgtgctcaactctctgcaggttcctgcctcttcggtttccttatcctgcttcccgagattgtgatgatttccacactgcctttctgtgggcccaaccaaatccatcagatcttctgtgacttggtccctgtgctaagcctggcctgtacagacacgtccatgattctgattgaggatgtgattcatgctgtgaccatcatcattaccttcctaatcattgccctgtcctatgtaagaattgtcactgtgatattgaggattccctcttctgaagggaggcaaaaggctttttctacctgtgcaggccacctcatggtcttcccgatattctttggcagtgtatcactcatgtacttgcgtttcagcgacacttatccaccagttttggacacagccattgcactgatgtttactgtacttgctccattcttcaatcccatcatttatagcctgagaaacaaggacatgaacaatgcgattaaaaaactgttctgtcttcaaaaagtgttgaacaagcctggaggttaa

SEQ ID NO: 162452 - DNA, 1172 bp, Homo sapiens
  Payload ID: 11954
  Gene Symbol: OR6K6
  Gene Name: olfactory receptor, family 6, subfamily K, member 6
  Uniprot ID: Q8NGW6
  ENST ID: ENST00000368144
  CDS Start-End: 97-1128
cagatgattttggcatggaggtaaagcttaagagatatttctaactggtttcttcaggattccagaatcagcttgagtaactcattacagaaaggaatgaagcaatattcagtgggtaatcaacattccaattataggagtctcttgtttccttttctgtgttcacagatgacacagttgacggccagtgggaatcagacaatggtgactgagttcctcttctctatgttcccgcatgcgcacagaggtggcctcttattctttattcccttgcttctcatctacggatttatcctaactggaaacctaataatgttcattgtcatccaggtgggcatggccctgcacacccctttgtatttctttatcagtgtcctctccttcctggagatctgctataccacaaccaccatccccaagatgctgtcctgcctaatcagtgagcagaagagcatttccgtggctggctgcctcctgcagatgtactttttccactcacttggtatcacagaaagctgtgtcctgacagcaatggccattgacaggtacatagctatctgcaatccactccgttacccaaccatcatgattcccaaactttgtatccagctgacagttggatcctgcttttgtggcttcctccttgtgcttcctgagattgcatggatttccaccttgcctttctgtggctccaaccagatccaccagatattctgtgatttcacacctgtgctgagcttggcctgcacagatacattcctagtggtcattgtggatgccatccatgcagcggaaattgtagcctccttcctggtcattgctctatcctacatccggattattatagtgattctgggaatgcactcagctgaaggtcatcacaaggccttttccacctgtgctgctcaccttgctgtgttcttgctattttttggcagtgtggctgtcatgtatttgagattctcagccacctactcagtgttttgggacacagcaattgctgtcacttttgttatccttgctccctttttcaaccccatcatctatagcctgaaaaacaaggacatgaaagaggctattggaaggcttttccactatcagaagagggctggttgggctgggaaatagatacagatcctggagactctaaaaagcctcttggaagagcaaaa

SEQ ID NO: 162453 - DNA, 1053 bp, Homo sapiens
  Payload ID: 11955
  Gene Symbol: OR6M1
  Gene Name: olfactory receptor, family 6, subfamily M, member 1
  Uniprot ID: Q8NGM8
  ENST ID: ENST00000309154
  CDS Start-End: 39-980
ttcttcagggaaaccctgcccaccatatagtagttgtcatgggaaactggagcactgtgactgaaatcaccctaattgccttcccagctctcctggagattcgaatatctctcttcgtggttcttgtggtaacttacacattaacagcaacaggaaacatcaccatcatctccctgatatggattgatcatcgcctgcaaactccaatgtacttcttcctcagtaatttgtcctttctggatatcttatacaccactgtcattaccccaaagttgttggcctgcctcctaggagaagagaaaaccatatcttttgctggttgcatgatccaaacatatttctacttctttctggggacggtggagtttatcctcttggcggtgatgtcctttgaccgctacatggctatctgcgacccactgcactacacggtcatcatgaacagcagggcctgccttctgctggttctgggatgctgggtgggagccttcctgtctgtgttgtttccaaccattgtagtgacaaggctaccttactgtaggaaagaaattaatcatttcttctgtgacattgcccctcttcttcaggtggcctgtataaatactcacctcattgagaagataaactttctcctctctgcccttgtcatcctgagctccctggcattcactactgggtcctacgtgtacataatttctaccatcctgcgtatcccctccacccagggccgtcagaaagctttttctacctgtgcttctcacatcactgttgtctccattgcccacgggagcaacatctttgtgtatgtgagacccaatcagaactcctcactggattatgacaaggtggccgctgtcctcatcacagtggtgacccctctcctgaacccttttatctacagcttgaggaatgagaaggtacaggaagtgttgagagagacagtgaacagaatcatgaccttgatacaaaggaaaacttgacactggtatacactacattaaatacatttctttttttattattttttttaagttccagggtacatgtgcagga

SEQ ID NO: 162454 - DNA, 939 bp, Homo sapiens
  Payload ID: 11956
  Gene Symbol: OR6N1
  Gene Name: olfactory receptor, family 6, subfamily N, member 1
  Uniprot ID: Q8NGY5
  ENST ID: ENST00000335094
  CDS Start-End: 1-939
atggacacagggaactggagccaggtagcagaattcatcatcttgggcttcccccatctccagggtgtccagatttatctcttcctcttgttgcttctcatttacctcatgactgtgttgggaaacctgctgatattcctggtggtctgcctggactcccggcttcacacacccatgtaccactttgtcagcattctctccttctcagagcttggctatacagctgccaccatccctaagatgctggcaaacttgctcagtgagaaaaagaccatttcattctctgggtgtctcctgcagatctatttctttcactcccttggagcgactgagtgctatctcctgacagctatggcctacgataggtatttagccatctgccggcccctccactacccaaccctcatgaccccaacactttgtgcagagattgccattggctgttggttgggaggcttggctgggccagtagttgaaatttccttgatttcacgcctcccattctgtggccccaatcgcattcagcacgtcttttgtgacttccctcctgtgctgagtttggcttgcactgatacgtctataaatgtcctagtagattttgttataaattcctgcaagatcctagccaccttcctgctgatcctctgctcctatgtgcagatcatctgcacagtgctcagaattccctcagctgccggcaagaggaaggccatctccacgtgtgcctcccacttcactgtggttctcatcttctatgggagcatcctttccatgtatgtgcagctgaagaagagctactcactggactatgaccaggccctggcagtggtctactcagtgctcacacccttcctcaaccccttcatctacagcttgcgcaacaaggagatcaaggaggctgtgaggaggcagctaaagagaattgggatattggcatga

SEQ ID NO: 162455 - DNA, 954 bp, Homo sapiens
  Payload ID: 11957
  Gene Symbol: OR6N2
  Gene Name: olfactory receptor, family 6, subfamily N, member 2
  Uniprot ID: Q8NGY6
  ENST ID: ENST00000339258
  CDS Start-End: 1-954
atggatcaatacaaccattcaagcctggctgaatttgtgttccttggctttgccagtgtgggctatgtcaggggctggctttttgtcctgctgctattggcatacctgttcaccatctgtggtaacatgctcatcttctcagtcatccgactggatgcagctctgcacacacctatgtaccactttgtcagtgttctttccttcttggagttgtggtatacagctaccactatccctaagatgttgtctaatattctcagtgagaagaaaaccatttcttttgcaggatgcctccttcagacctacttcttccactccttgggagcgtctgaatgctaccttcttacagccatggcctatgatagatacctggccatttgtcggcccctccactaccctataattatgaccaccacactctgtgccaagatggctgctgcttgttggacttgtggcttcctgtgtcccatttctgaggtcatccttgcctcccagctcccattttgtgcttacaatgaaatccaacacattttctgtgactttccacctttgctgagcttggcctgcaaggacacatctgctaacattctggtggactttgccattaatgctttcataattcttatcactttcttctttatcatgatttcttatgcaaggatcattggggctgtgctgaagataaaaacagcatcaggaagaaagaaggccttttctacctgtgcctcacatcttgctgtggtcctcatcttctttgggagcatcatcttcatgtatgtgcggctaaagaagagctattccctgacccttgaccgaacacttgctatagtttactccgtactaacaccaatggtcaatccaattatctacagtcttcgtaacaaggaaatcattaaagctatcaagaggaccatcttccagaagggagataaagctagtcttgctcatctttga

SEQ ID NO: 162456 - DNA, 954 bp, Homo sapiens
  Payload ID: 11958
  Gene Symbol: OR6P1
  Gene Name: olfactory receptor, family 6, subfamily P, member 1
  Uniprot ID: Q8NGX9
  ENST ID: ENST00000334632
  CDS Start-End: 1-954
atgagaaatttgagtggaggccatgtcgaggagtttgtcttggtgggtttccctaccacgcctcccctccagctgctcctctttgtccttttttttgcaatttaccttctgacattgttggagaatgcacttattgtcttcacaatatggcttgctccaagccttcatcgtcccatgtactttttccttggccatctctctttcctggagctatggtacatcaatgtcaccattcctcggctcttggcagcctttcttacccaggatggtagagtctcctacgtaggttgcatgacccaactgtacttctttattgccttagcctgtactgaatgtgtgctgttggcagttatggcctatgatcgctacctggccatctgtggacccctcctttaccctagtctcatgccttccagtctggccactcgccttgctgctgcctcttggggcagtggcttcttcagctccatgatgaagcttctttttatttcccaattgtcctactgtggacccaacattatcaaccactttttctgtgatatttccccactactcaacctcacctgctctgacaaggagcaagcagagctagtagacttccttctggccctggtgatgattctactccctctattggctgtggtttcatcatacactgccatcattgcagccatcctgaggatccctacgtccaggggacgccacaaagccttttccacttgtgccgctcatctggcagtggttgttatctactactcctccactctcttcacctatgcacggccccgggccatgtacaccttcaaccacaacaagattatctctgtgctctacactatcattgtaccattcttcaacccagccatctactgcctgaggaacaaggaggtgaaggaggccttcaggaagacagtgatgggcagatgtcactatcctagggatgttcaggactga

SEQ ID NO: 162457 - DNA, 954 bp, Homo sapiens
  Payload ID: 11959
  Gene Symbol: OR6Q1
  Gene Name: olfactory receptor, family 6, subfamily Q, member 1 (gene/pseudogene)
  Uniprot ID: Q8NGQ2
  ENST ID: ENST00000623976
  CDS Start-End: 1-954
atgcaaccatataccaaaaactggacccaggtaactgaatttgtcatgatgggctttgctggcatccatgaagcacacctcctcttcttcatactcttcctcaccatgtacctgttcaccttggtggagaatttggccatcattttagtggtgggtttggaccaccgactacggagacccatgtatttcttcctgacacacttgtcctgccttgaaatctggtacacttctgttacagtgcccaagatgctggctggttttattggggtggatggtggcaagaatatctcttatgctgattgcctatcccagctcttcatcttcacctttcttggggcaactgagtgtttcctactggctgccatggcctatgatcgttatgtggccatttgtatgcctctccactatggggcttttgtgtcctggggcacctgcatccgtctggcagctgcctgttggctggtaggtttcctcacacccatcttgccaatctacctcttgtctcagctaacattttatggcccaaatgtcattgaccatttctcctgtgatgcctcacccttgctagccttgtcgtgctcagatgtcacttggaaggagactgtggatttcctggtgtctctggctgtgctactggcctcctctatggtcattgctgtgtcctatggcaacatcgtctggacactgctgcacatccgctcagctgctgagcgctggaaggccttctctacctgtgcagctcacctgactgtggtgagcctcttctatggcactcttttctttatgtatgtccagaccaaggtgacctcctccatcaacttcaacaaggtggtatctgtcttctactctgttgtcacgcccatgctcaatcctctcatctacagtcttaggaacaaggaagtgaagggagctctgggtcgagtcttttctctcaacttttggaagggacagtga

SEQ ID NO: 162458 - DNA, 996 bp, Homo sapiens
  Payload ID: 11960
  Gene Symbol: OR6S1
  Gene Name: olfactory receptor, family 6, subfamily S, member 1
  Uniprot ID: Q8NH40
  ENST ID: ENST00000320704
  CDS Start-End: 1-996
atgagtcctgatgggaaccacagtagtgatccaacagagttcgtcctggcagggctcccaaatctcaacagcgcaagagtggaattattttctgtgtttcttcttgtctatctcctgaatctgacaggcaatgtgttgattgtgggggtggtaagggctgatactcgactacagacccctatgtacttctttctgggtaacctgtcctgcctagagatactgctcacttctgtcatcattccaaagatgctgagcaatttcctctcaaggcaacacactatttcctttgctgcatgtatcacccaattctatttctacttctttctcggggcctccgagttcttactgttggctgtcatgtctgcggatcgctacctggccatctgtcatcctctgcgctaccccttgctcatgagtggggctgtgtgctttcgtgtggccttggcctgctgggtggggggactcgtccctgtgcttggtcccacagtggctgtggccttgcttcctttctgtaagcagggtgctgtggtacagcacttcttctgcgacagtggcccactgctccgcctggcttgcaccaacaccaagaagctggaggagactgactttgtcctggcctccctcgtcattgtatcttccttgctgatcactgctgtgtcctacggcctcattgtgctggcagtcctgagcatcccctctgcttcaggccgtcagaaggccttctctacctgtacctcccacttgatagtggtgaccctcttctatggaagtgccatttttctctatgtgcggccatcgcagagtggttctgtggacactaactgggcagtgacagtaataacgacatttgtgacaccactgttgaatccattcatctatgccttacgtaatgagcaagtcaaggaagctttgaaggacatgtttaggaaggtagtggcaggcgttttagggaatcttttacttgataaatgtctcagtgagaaagcagtaaagtaa

SEQ ID NO: 162459 - DNA, 1089 bp, Homo sapiens
  Payload ID: 11961
  Gene Symbol: OR6T1
  Gene Name: olfactory receptor, family 6, subfamily T, member 1
  Uniprot ID: Q8NGN1
  ENST ID: ENST00000321252
  CDS Start-End: 36-1007
gagttctgtttcatttcccctgcaggtgactgaagatgaaccctgaaaactggactcaggtaacaagctttgtccttctgggtttccccagtagccacctcatacagttcctggtgttcctggggttaatggtgacctacattgtaacagccacaggcaagctgctaattattgtgctcagctggatagaccaacgcctgcacatacagatgtacttcttcctgcggaatttctccttcctggagctgttgctggtaactgttgtggttcccaagatgcttgtcgtcatcctcacgggggatcacaccatctcatttgtcagctgcatcatccagtcctacctctacttctttctaggcaccactgacttcttcctcttggccgtcatgtctctggatcgttacctggcaatctgccgaccactccgctatgagaccctgatgaatggccatgtctgttcccaactagtgctggcctcctggctagctggattcctctgggtcctttgccccactgtcctcatggccagcctgcctttctgtggccccaatggtattgaccacttctttcgtgacagttggcccttgctcaggctttcttgtggggacacccacctgctgaaactggtggctttcatgctctctacgttggtgttactgggctcactggctctgacctcagtttcctatgcctgcattcttgccactgttctcagggcccctacagctgctgagcgaaggaaagcgttttccacttgcgcctcgcatcttacagtggtggtcatcatctatggcagttccatctttctctacattcgtatgtcagaggctcagtccaaactgctcaacaaaggtgcctccgtcctgagctgcatcatcacacccctcttgaacccattcatcttcactctccgcaatgacaaggtgcagcaagcactgagagaagccttggggtggcccaggctcactgctgtgatgaaactgagggtcacaagtcaaaggaaatgatcttattaaatgggagattaaatgtttattgaaaattttttaaatgtgcaagaagtttaagggatgtaggcaacactgttca

SEQ ID NO: 162460 - DNA, 1028 bp, Homo sapiens
  Payload ID: 11962
  Gene Symbol: OR6V1
  Gene Name: olfactory receptor, family 6, subfamily V, member 1
  Uniprot ID: Q8N148
  ENST ID: ENST00000418316
  CDS Start-End: 22-963
cagggccccatactgtggatcatggcaaatctgagccagccctccgaatttgtcctcttgggcttctcctcctttggtgagctgcaggcccttctgtatggccccttcctcatgctttatcttctcgccttcatgggaaacaccatcatcatagttatggtcatagctgacacccacctacatacacccatgtacttcttcctgggcaatttttccctgctggagatcttggtaaccatgactgcagtgcccaggatgctctcagacctgttggtcccccacaaagtcattaccttcactggctgcatggtccagttctacttccacttttccctggggtccacctccttcctcatcctgacagacatggcccttgatcgctttgtggccatctgccacccactgcgctatggcactctgatgagccgggctatgtgtgtccagctggctggggctgcctgggcagctcctttcctagccatggtacccactgtcctctcccgagctcatcttgattactgccatggcgacgtcatcaaccacttcttctgtgacaatgaacctctcctgcagttgtcatgctctgacactcgcctgttggaattctgggactttctgatggccttgacctttgtcctcagctccttcctggtgaccctcatctcctatggctacatagtgaccactgtgctgcggatcccctctgccagcagctgccagaaggctttctccacttgcgggtctcacctcacactggtcttcatcggctacagtagtaccatctttctgtatgtcaggcctggcaaagctcactctgtgcaagtcaggaaggtcgtggccttggtgacttcagttctcaccccctttctcaatccctttatccttaccttctgcaatcagacagttaaaacagtgctacaggggcagatgcagaggctgaaaggcctttgcaaggcacaatgatgagcccagggcccaggggaacctggcctgcctccattgagcagttctgtggggagggagacctc

SEQ ID NO: 162461 - DNA, 1028 bp, Homo sapiens; identical to SEQ ID NO: 162460
  Payload ID: 11962
  Gene Symbol: OR6V1
  Gene Name: olfactory receptor, family 6, subfamily V, member 1
  Uniprot ID: Q8N148
  ENST ID: ENST00000615548
  CDS Start-End: 22-963

SEQ ID NO: 162462 - DNA, 1058 bp, Homo sapiens
  Payload ID: 11963
  Gene Symbol: OR6X1
  Gene Name: olfactory receptor, family 6, subfamily X, member 1
  Uniprot ID: Q8NH79
  ENST ID: ENST00000327930
  CDS Start-End: 28-966
gcttgtctttctagggtatcaagggacatgagaaatggcacagtaatcacagaattcatcctgctaggctttcctgttatccaaggcctacaaacacctctctttattgcaatctttctcacctacatattaacccttgcaggcaatgggcttattattgccactgtgtgggctgagcccaggctacaaattccaatgtacttcttcctttgtaacttgtctttcttagaaatctggtacaccaccacagtcatccccaaactgctaggaacctttgtagtggcaagaacagtaatctgcatgtcctgctgcctgctgcaggccttcttccacttcttcgtgggcaccaccgagttcttgatcctcactatcatgtcttttgaccgctacctcaccatctgcaatccccttcaccaccccaccatcatgaccagcaaactctgcctgcagctggccctgagctcctgggtggtgggcttcaccattgtcttttgtcagacgatgctgctcatccagttgccattctgtggcaataatgttatcagtcatttctactgtgatgttgggcccagtttgaaagccgcctgcatagacaccagcattttggaactcctgggcgtcatagcaaccatccttgtgatcccagggtcacttctctttaatatgatttcttatatctacattctgtccgcaatcctacgaattccttcagccactggccaccaaaagactttctctacctgtgcctcgcacctgacagttgtctccctgctctacggggctgttctgttcatgtacctaagacccacagcacactcctcctttaagattaataaggtggtgtctgtgctaaatactatcctcaccccccttctgaatccctttatttatactattagaaacaaggaggtgaagggagccttaagaaaggcaatgacttgcccaaagactggtcatgcaaagtaaaacatgcaacacatcaaagtgagcttaatgcagataaaaacaatgaaagttgagagaggattttggagaagtttggtaaaacaggctccccc

SEQ ID NO: 162463 - DNA, 978 bp, Homo sapiens
  Payload ID: 11964
  Gene Symbol: OR6Y1
  Gene Name: olfactory receptor, family 6, subfamily Y, member 1
  Uniprot ID: Q8NGX8
  ENST ID: ENST00000302617
  CDS Start-End: 1-978
atgaccaccataattctggaagtagataatcatacagtgacaacacgtttcattcttctggggtttccaacacgaccagccttccagcttctctttttctccattttcctggcaacctatctgctgacactgctggagaatcttcttatcatcttagctatccacagtgatgggcagctgcataagcccatgtacttcttcttgagccacctctccttcctggagatgtggtatgtcacagtcatcagccccaagatgcttgttgacttcctcagtcatgacaagagtatttccttcaatggctgcatgactcaactttacttttttgtgacctttgtctgcactgagtacatccttcttgctatcatggcctttgaccgctatgtagccatttgtaatccactacgctacccagtcatcatgaccaaccagctctgtggcacactggctggaggatgctggttctgtggactcatgactgccatgattaagatggtttttatagcacaacttcactactgtggcatgcctcagatcaatcactacttttgtgatatctctccactccttaacgtctcctgtgaggatgcctcacaggctgagatggtggacttcttcttggccctcatggtcattgctattcctctttgtgttgtggtggcatcctacgctgctatccttgccaccatcctcaggatcccttctgctcagggccgccaaaaggcattctccacctgtgcctcccacctgaccgtcgtaattctcttctattccatgacacttttcacctatgcccgtcccaaactcatgtatgcctacaattccaacaaagtggtatctgttctctacactgtcattgttccactcctcaaccccatcatttactgtctgaggaaccatgaagtaaaggcagccctcagaaagaccatacattgcagaggaagtgggccccagggaaatggggctttcagtagttaa

SEQ ID NO: 162464 - DNA, 930 bp, Homo sapiens
  Payload ID: 11965
  Gene Symbol: OR7A10
  Gene Name: olfactory receptor, family 7, subfamily A, member 10
  Uniprot ID: O76100
  ENST ID: ENST00000248058
  CDS Start-End: 1-930
atgaaatcatggaacaatacaataattttagaatttcttctcctgggaatttcagaggaaccagaattgcaggccttcctctttgggctgttcctgtccatgtacctggtcactgtgctcgggaacctgctcatcatcctggccacaatctcagactcccacctccacacccccatgtacttcttcctctccaacctgtccttcgtagacatctgttttgtctctaccactgtcccgaagatgctggtgaacatccagacacacaacaaagtcatcacctatgcaggctgcatcacccagatgtgctttttcttactctttgtaggattggataacttccttctgaccgtgatggcctatgaccggtttgtggccatctgtcaccctctgcactacatggtcattatgaaccctcaactctgtggactgctggttctggcatcctggatcatgagtgttctgaattccatgttacaaagcttaatggtgttgccactgcccttttgtacacacatggaaatccctcattttttctgtgaaattaatcaggtggtccaccttgcctgttctgacacctttcttaatgacatagtgatgtattttgcagtagcgctgctgggcggtggtcccctcactgggatcctgtactcttactctaagatagtttcctccatacgtgcaatctcatcagctcaggggaagtataaggcattttccacctgtgcatctcacctctcagttgtctccttattttatggtacatgcttaggggtgtaccttagttctgctgccacccacaattcacacacaggtgctgcagcctcagtgatgtacactgtggtcacccccatgctgaaccccttcatctacagtctgaggaataaacacataaagggtgctatgaaaacattcttcagaggaaagcaatag

SEQ ID NO: 162465 - DNA, 1027 bp, Homo sapiens
  Payload ID: 11966
  Gene Symbol: OR7A17
  Gene Name: olfactory receptor, family 7, subfamily A, member 17
  Uniprot ID: O14581
  ENST ID: ENST00000327462
  CDS Start-End: 98-1027
ggttcagaccagcgttggcaacagagtgagagaccctgtctatgttaataaataaataaataaataaataaataaataaataaatagaaaaaaaaagatggaaccagagaatgacacagggatttcagaatttgttcttctgggactttctgaggaaccagaattgcagcccttcctctttgggctgtttctgtccatgtacctggtcactgtgctcgggaatctgctcatcatcctggccacaatctcagactcccacctccacacccccatgtacttcttcctctccaacctgtcctttgcagacatctgtttcatctccactacaatcccaaagatgctcattaacatccagacacagagcagagtcatcacctatgcaggctgcatcacccagatgtgcttttttgtactttttggagggttagacagcttactcctggctgtgatggcctatgatcggtttgtggccatctgtcatcctctgcactacacagtcatcatgaaccctcggctctgtggactcctggttctggcatcctggatgattgctgccctgaattccttgtcacaaagcttaatggtattgtggctgtccttctgcacagacttggaaatcccccactttttctgtgaacttaatcaggtcatccaccttgcctgttctgacacctttcttaatgacatggggatgtattttgcagcagggctgctggctggtggtccccttgtggggatcctttgctcttactctaagatagtttcctccatacgtgcaatctcatcagctcaggggaagtacaaggcattttccacctgtgcatcacacctctcagttgtctctttattttgttgtacgggcctaggtgtgtaccttacttctgctgcaacccacaactcacacacaagtgcaacagcctcagtgatgtacactgtggccacccccatgctgaacccctttatctacagtctgaggaataaagacataaagagggctctgaaaatgtccttcagaggaaagcaataa

SEQ ID NO: 162466 - DNA, 1048 bp, Homo sapiens
  Payload ID: 11967
  Gene Symbol: OR7A5
  Gene Name: olfactory receptor, family 7, subfamily A, member 5
  Uniprot ID: Q15622
  ENST ID: ENST00000322301
  CDS Start-End: 89-1048
agtctccaccatcaatcatccagtgaggaatttgcacttacacaaggaactcttcctcggagagatcccctcctgtcacttcaatcaaatggaaccaggaaatgatacacaaatttcagaatttcttcttctgggattttcacaagaacctggactgcaacccttcctctttgggctgttcctgtccatgtacctggtcactgtgctcgggaacctgctcatcatcctggccacaatctcagactcccacctccacacccccatgtacttcttcctctccaacctgtcctttgctgacatttgtgttacttccaccaccattccaaaaatgctgatgaacatccagacacagaacaaagtcatcacctacatagcctgcctcatgcagatgtattttttcatactctttgctggatttgaaaacttcctcctgtccgtgatggcctatgaccggtttgtggccatctgtcaccccctgcactacatggtcattatgaaccctcacctctgtggactgctggttctagcatcctggaccatgagtgctctgtattccttgctacaaatcttaatggtagtacggctgtccttctgcacagccttagaaatcccccactttttctgtgaacttaatcaggtcatccaacttgcttgttctgatagctttcttaatcacatggtgatatattttacagttgcgctgctgggtggaggtcccctgactgggatcctttactcttactctaagataatttcttccatacatgcaatctcatcagctcaggggaagtacaaggcattttccacctgtgcatctcacctctcagttgtctccttattttatggtgcaatcctaggggtgtaccttagttctgctgccacccgcaactcacactcaagtgcaacagcctcagtgatgtacactgtggtcacccccatgctgaacccctttatctatagtctgaggaataaagacataaagagggctctgggaatacatttgttgtggggaacaatgaaagggcaatttttcaagaagtgcccatga

SEQ ID NO: 162467 - DNA, 1029 bp, Homo sapiens
  Payload ID: 11967
  Gene Symbol: OR7A5
  Gene Name: olfactory receptor, family 7, subfamily A, member 5
  Uniprot ID: Q15622
  ENST ID: ENST00000594432
  CDS Start-End: 59-1018
tgcatgcctgtctcgtttccctctttctctctctctctctgatagtcacttcaatcaaatggaaccaggaaatgatacacaaatttcagaatttcttcttctgggattttcacaagaacctggactgcaacccttcctctttgggctgttcctgtccatgtacctggtcactgtgctcgggaacctgctcatcatcctggccacaatctcagactcccacctccacacccccatgtacttcttcctctccaacctgtcctttgctgacatttgtgttacttccaccaccattccaaaaatgctgatgaacatccagacacagaacaaagtcatcacctacatagcctgcctcatgcagatgtattttttcatactctttgctggatttgaaaacttcctcctgtccgtgatggcctatgaccggtttgtggccatctgtcaccccctgcactacatggtcattatgaaccctcacctctgtggactgctggttctagcatcctggaccatgagtgctctgtattccttgctacaaatcttaatggtagtacggctgtccttctgcacagccttagaaatcccccactttttctgtgaacttaatcaggtcatccaacttgcttgttctgatagctttcttaatcacatggtgatatattttacagttgcgctgctgggtggaggtcccctgactgggatcctttactcttactctaagataatttcttccatacatgcaatctcatcagctcaggggaagtacaaggcattttccacctgtgcatctcacctctcagttgtctccttattttatggtgcaatcctaggggtgtaccttagttctgctgccacccgcaactcacactcaagtgcaacagcctcagtgatgtacactgtggtcacccccatgctgaacccctttatctatagtctgaggaataaagacataaagagggctctgggaatacatttgttgtggggaacaatgaaagggcaatttttcaagaagtgcccatgattgcagggctc

SEQ ID NO: 162468 - DNA, 1066 bp, Homo sapiens
  Payload ID: 11968
  Gene Symbol: OR7C1
  Gene Name: olfactory receptor, family 7, subfamily C, member 1
  Uniprot ID: O76099
  ENST ID: ENST00000248073
  CDS Start-End: 76-1038
ccaaatttccatgttgccagtgtgttgataattgactgttgcttttttctctcttgtggcagttattttatccccatggaaacaggaaatcaaacacatgcccaagaatttctcctcctgggattttcagcaacgtcagagattcagttcattctctttgggctgttcctctccatgtacctagtcactttcaccgggaacctgctcatcatcctggccatatgctcagactcccacctccacacccccatgtacttcttcctctccaacctgtcttttgctgacctctgttttacctccacgactgtcccaaagatgttactgaatatactgacacagaacaaattcataacatatgcaggctgtctcagtcagattttttttttcacttcatttggatgcctggacaatttactcttgaccgtgatggcctatgaccgcttcgtggccgtctgtcaccccctgcactatacggtcatcatgaacccccagctctgtggactgctggttctggggtcctggtgcatcagtgtcatgggttccctgctcgagaccttgactgttttgaggctgtccttctgcaccgaaatggaaattccacactttttttgtgatctacttgaagtcctgaagctcgcctgttctgacaccttcattaataacgtggtgatatactttgcaactggcgtcctgggtgtgatttccttcactggaatatttttctcttactataaaattgttttctctatactgaggatttcctcagctgggagaaagcacaaagcgttttccacctgtggttcccacctctcagtggtcaccttgttctatggcacgggctttggggtctatctcagttctgcagccacaccatcttctaggacaagtctggtggcctcagtgatgtacaccatggtcacccccatgctgaaccccttcatctacagcctgaggaacacggacatgaagagggccctggggagactcctcagtagggcaacattttttaatggtgacatcactgcaggactttcataagtagcaaggcttggaccattgggaggca

SEQ ID NO: 162469 - DNA, 960 bp, Homo sapiens
  Payload ID: 11969
  Gene Symbol: OR7C2
  Gene Name: olfactory receptor, family 7, subfamily C, member 2
  Uniprot ID: O60412
  ENST ID: ENST00000248072
  CDS Start-End: 1-960
atggaaagaggaaaccaaacagaagttggaaactttctcctcctgggattcgcagaggactctgacatgcagcttctcctccatgggctgttcctctccatgtacctggttaccatcatcggaaacctgctcatcatcctgaccatcagttcagactcccacctccacacccccatgtacttcttcctctccaacctgtcctttgctgacatctgtttcacatccacgactgtcccaaagatgctggtgaatatccaaacacaaagcaaaatgatcacttttgcaggctgcctcactcagatattttttttcattgcatttggatgcctggacaatttgctcctgaccatgacggcctatgaccgcttcgtggccatctgttaccccctgcactacacggtcatcatgaacccccggctctgtggactgctggttctggggtcctggtgcatcagtgtcatgggttccttgcttgagaccttgaccattttgaggctgtccttctgcacaaatatggaaattccgcactttttttgtgatccttccgaagtcctgaagctggcctgttctgacaccttcatcaataacatcgtgatgtattttgtgaccattgtcctgggtgtttttcctctctgtggaatcctattctcttattctcagattttctcctccgtcctaagagtatctgccagaggccagcacaaagccttttccacctgtggttcccacctctcagtggtcagcttgttctatggcactggccttggggtctatctcagttctgcagttacaccaccttctaggacaagtctggcagcctcggtgatgtacaccatggtcacccccatgctgaaccccttcatctacagcctgaggaacaaggacatgaaggggtcactggggagactcctcctcagggcaacgtctctcaaagaggggaccattgctaagctctcatga

SEQ ID NO: 162470 - DNA, 3224 bp, Homo sapiens
  Payload ID: 11970
  Gene Symbol: OR7D2
  Gene Name: olfactory receptor, family 7, subfamily D, member 2
  Uniprot ID: Q96RA2
  ENST ID: ENST00000344248
  CDS Start-End: 189-1127
ttattttttgagacagttctccctctattgcccaggctggagtgcagtggtgtaaacatagctccctgcagttgcaaattcctgggctcaagtgatccttccatctcagcctcccgagtagctgggactacaggtgtccaccaccatgcctggctaatgacctcttcttttgtagatacatcagctacatggaagcaggaaaccaaacaggatttttagagtttatccttctcggactctctgaggatccagaactacagccgttcatatttgggctgttcctgtccatgtacctggtgacggtgctgggaaacctgctcatcatcctggccatcagctctgactcccacctccacacccccatgtacttcttcctctccaacctgtcctgggttgacatctgtttcagcacttgcatcgtccccaagatgctggtgaacatccagaccgagaacaaagccatctcctacatggactgcctcacacaggtctatttctccatgttttttcctattctggacacgctactcctgaccgtgatggcctatgaccggtttgtggctgtctgccaccctctgcactatatgatcatcatgaacccccacctctgtggcctcctggtttttgtcacctggctcattggtgtcatgacatccctcctccatatttctctgatgatgcatctaatcttctgtaaagattttgaaattccacattttttctgcgaactgacgtacatcctccagctggcctgctctgataccttcctgaacagcacgttgatatactttatgacgggtgtgctgggcgtttttcccctccttgggatcattttctcttattcacgaattgcttcatccataaggaagatgtcctcatctgggggaaaacaaaaagcactttccacctgtgggtctcacctctccgtcgtttctttattttatgggacaggcattggggtccacttcacttctgcggtgactcactcttcccagaaaatctccgtggcctcggtgatgtacactgtggtcacccccatgttgaaccccttcatctacagcctgaggaacaaggatgtgaagggagccctggggagtctcctcagcagggcagcctcttgtttgtgatggatcccttggccccaggactaagaagttttgtgagcaccaatggcaaaaatgttttattttgaaattcttactctttaaaattaaaaacatttttttatactttgagagtacaaatgcagatttcttaacatgcatttgcataagggtgaagtctgagcttttggcgtaccaattacctgaatagtgaacataaggcacttttttttcttttttgagacggagtctcactctgtctcccaggctggagtgcagtggagtgatctcggctcactgcaacctccgcctcccgggttcaagtgattcttctgtctcagcctcctgagtagctgagattacaggtgtgtgccacccatgccttttagtagagacggggtttcaccatcttggccaggctggtctcgaactcctgaccttgtgatccacctgccttggcctctcaaagtgctgggattacaggtgtgagccaccacgcccggccaaggcagtttttaaactctcactcccctctcaccttttgcagtctccagtgtccattattctgttataatgcccatgcgtatacattgtttagctcccaattataagtgagatcatgcagcatttgactttgtttctttactaccttacttaagagaatggcttccagtcccatcgatgttgctgcaaaagacatgatttcatccttttttatggctgagtagtactccattgtatatatcctcgatatctatatagatatagacatatgtagatacataccatgttttctttttttaaaaaaatttatttttatgtcagtagtttttggggtacatgtggtttttcattacacggatgagttctttagtggtgacttctgagtttttagtgtacccgtcacccaagtggtagtagtctcttattcctcacccccctcccaacctttctcccttcaagtcaccaaagttcattatattgttcatatccctttgtgtcctcatagcttagctcccacttataactgagaacatacgatatgttcatatggatcttatgtatgttggttgaacatacaaacaagtccaggtttttcattcctgagttacttcacctagagtaatgacctccagttccatccaagttgctacaaaagacattatttggttcctttttatggataagtagtattccatgctgtacatataccacaatctttatcactcattggttgatgggcacttaggttggttccatgcctttgtaattgctaattatgttgctataaacatgcaggtgtatgtgtctttttcacataatgactttgtttcctttgggtagatacccagtagtggaactgctggactgaaaggtagttctacttttagttcttttttttgttttttttttaagacagagtctcactctgttgcccaggctggagtgcagtggcgcgatctcatctcactgcaacctccacctcccaggttcaagcgattctcctgcctcaacctcctgagtagctgggactacaggcacctgccaccccacccagctaattcttctatttttagtagagacagggtttcaccatgttggccaggctggtcttgaactcctgacctcaggtgatacgcccacctcggcctcccaaagtgctgggattacaggtgtgagccactgtgcctggccttctagttctttaagataccactttaaaaaaagtccagtcctccattgatggacacgtaggttgattccatatctttgctaatgtgaatagtgccgtgataaacatgggggtgtaagttaacaattaatctccaagtaatttccttgatggcacttctgtcctatgtgctattcaaaaattgtgtccttgatcatcgttcttaattctccattagtgagttctgaacttgggtttgaagcatttgctatagctttgttatctcaagtggtggcacagagttcttaagctattgattgttcactgactttatttctatgtgtttgcatgtgggtttttgttgtttgtgtgttcgatcatgaacagatcaacagtgtttatttgttttcctactggatgaagtatgattaaaatacgtatttaaatat

SEQ ID NO: 162471 - DNA, 1022 bp, Homo sapiens
  Payload ID: 11971
  Gene Symbol: OR7D4
  Gene Name: olfactory receptor, family 7, subfamily D, member 4
  Uniprot ID: Q8NG98
  ENST ID: ENST00000308682
  CDS Start-End: 35-973
tttttcctccttccccagcagacacaacagctacatggaagcagaaaaccttacagaattatcaaaatttctcctcctgggactctcagatgatcctgaactgcagcccgtcctctttgggctgttcctgtccatgtacctggtcacggtgctggggaacctgctcatcattctggccgtcagctctgactcccacctccacacccccatgtacttcttcctctccaacctgtcctttgttgacatctgtttcatctccaccacagtccccaagatgctagtgagcatccaggcacggagcaaagacatctcctacatggggtgcctcactcaggtgtattttttaatgatgtttgctggaatggatactttcctactggccgtgatggcctatgaccggtttgtggccatctgccacccactgcactacacggtcatcatgaacccctgcctctgtggcctcctggttctggcatcttggttcatcattttctggttctccctggttcatattctactgatgaagaggttgaccttctccacaggcactgagattccgcatttcttctgtgaaccggctcaggtcctcaaggtggcctgctctaacaccctcctcaataacattgtcttgtatgtggccacggcactgctgggtgtgtttcctgtagctgggatcctcttctcctactctcagattgtctcctccttaatgggaatgtcctccaccaagggcaagtacaaagccttttccacctgtggatctcacctctgtgtggtctccttgttctatggaacaggacttggggtctatctgagttctgctgtgacccattcttcccagagcagctccaccgcctcagtgatgtacgccatggtcacccccatgctgaaccccttcatctacagcctgaggaacaaggatgtgaagggggccctggaaagactcctcagcagggccgactcttgtccatgacaaatcagggcctcagaactaagaggacacactgcgtacccctaaggca

SEQ ID NO: 162472 - DNA, 1550 bp, Homo sapiens
  Payload ID: 11972
  Gene Symbol: OR7E24
  Gene Name: olfactory receptor, family 7, subfamily E, member 24
  Uniprot ID: Q6IFN5
  ENST ID: ENST00000456448
  CDS Start-End: 115-1134
tgggtttgtcacaactgagaactattgctgagggtgtataatcctatgtgaaaacttaatttcttaattgcttgtatccaaaatatagacacagtgctagatgctggtttacttatgtcctattttccaattctctttttttttttcctcaaaaggtgtccgagctacacagagccacagaatctcacaggtgtctcagaattcctcctcctgggactctcagaggatccagaactgcagccggtcctcgctgggctgttcctgtccatgtacctggtcacggtgctggggaacctgctcatcatcctggctgtcagctctgactcccacctccacacccccatgtacttcttcctctccaacctgtccttggctgacatcggtttcacctccaccacggtccccaagatgattgtggacatgcaaactcacagcagagtcatctcctatgaaggctgcctgactcagatgtctttttttgtcctttttgcatgtatggatgacatgctcctgagtgtgatggcctatgaccggtttgtggccatctgtcaccccctgcactaccgaatcatcatgaacccacgcctctgtggcttcttaatcttgttgtctttttttattagtcttttggactcccagttgcacaatttgattatgttacagctcacctgcttcaaggatgtggacatttctaatttcttctgtgacccttctcaactcctccaccttaggtgttccgacaccttcatcaatgaaatggtcatatatttcatgggtgccatatttggctgtctccctatctcagggatccttttctcttactataaaattgtttcccccattctgagagttccaacatcagatgggaagtataaagccttctccacctgtggctctcacctggcagttgtttgcttattttatggaacagggcttgtagggtacctcagttcagctgtgttaccatcccccaggaagagtatggtggcttcagtgatgtacactgtggtcacccccatgctgaaccccttcatctacagcctgaggaacaaggacattcaaagtgccctgtgcaggctgcatggcagaatcatcaaatctcatcatctccatcctttttgttatatgggatagaaatggcagcaaaatttaacacctaggcctgcaaattctgcctccttggtcacattattttggttgcttgatggctttcattcctctctgggtttcgtatgtgaatattgcttgctttgttttgtctttaattgcaatgggtgagtattctggtatcctttgttcatcatacacatcatgaatgattccaatatacctagacagcctcctttagtatctgtgcaatgaccttgatatccaggtgcaatcacaatcttttctgatagacttgaaatcctcacttaactttgtcaagaggtttttggaaactgcaactttaaaaaaaaagcgcagcaggtcctgaaataagttcattttgttcaatgttgtttagttttaattttggtgagaaatgaataaattggtttcatggttca

SEQ ID NO: 162473 - DNA, 936 bp, Homo sapiens
  Payload ID: 11973
  Gene Symbol: OR7G1
  Gene Name: olfactory receptor, family 7, subfamily G, member 1
  Uniprot ID: Q8NGA0
  ENST ID: ENST00000541538
  CDS Start-End: 1-936
atgggacccagaaaccaaacagctgtttcagaatttcttctcatgaaagtgacagaggacccagaactgaagttaatccctttcagcctgttcctgtccatgtacctggtcaccatcctggggaacctgctcattctcctggctgtcatctctgactcccacctccacacccccatgtacttccttctctttaatctctcctttactgacatctgtttaaccacaaccacagtcccaaagatcctagtgaacatccaagctcagaatcagagtatcacttacacaggctgcctcacccagatctgtcttgtcttggtttttgctggcttggaaagttgctttcttgcagtcatggcctacgaccgctatgtggccatttgccacccactgaggtacacagtcctcatgaatgtccatttctggggcttgctgattcttctctccatgttcatgagcactatggatgccctggttcagagtctgatggtattgcagctgtccttctgcaaaaacgttgaaatccctttgttcttctgtgaagtcgttcaggtcatcaagctcgcctgttctgacaccctcatcaacaacatcctcatatattttgcaagtagtgtatttggtgcaattcctctctctggaataattttctcttattctcaaatagtcacctctgttctgagaatgccatcagcaagaggaaagtataaagcgttttccacctgtggctgtcacctctctgttttttccttgttctatgggacagcttttggggtgtacattagttctgctgttgctgagtcttcccgaattactgctgtggcttcagtgatgtacactgtggtccctcaaatgatgaaccccttcatctacagcctgagaaataaggagatgaagaaagctttgaggaaacttattggtaggctgtttcctttttag

SEQ ID NO: 162474 - DNA, 1038 bp, Homo sapiens
  Payload ID: 11974
  Gene Symbol: OR7G2
  Gene Name: olfactory receptor, family 7, subfamily G, member 2
  Uniprot ID: Q8NG99
  ENST ID: ENST00000305456
  CDS Start-End: 1-1038
atgccgatgcagctgctgcttacagattttattatcttttccatcagattcatcatcaacagcatggaagcgagaaaccaaacagctatttcaaaattccttctcctgggactgatagaggatccggaactgcagcccgtccttttcagcctgttcctgtccatgtacttggtcaccatcctggggaacctgctcatcctcttggctgtcatctctgactctcacctccacacccccatgtacttcttcctctccaatctctcctttttggacatttgtttaagcacaaccacgatcccaaagatgctggtgaacatccaagctcagaatcggagcatcacgtactcaggctgcctcacccagatctgctttgtcttgttttttgctggcttggaaaattgtctccttgcagcaatggcctatgaccgctatgtggccatttgtcacccccttagatacacagtcatcatgaacccccgcctctgtggcctgctgattcttctctctctgttgactagtgttgtgaatgcccttcttctcagcctgatggtgttgaggctgtccttctgcacagacctggaaatcccgctcttcttctgtgaactggctcaggtcatccaactcacctgttcagacaccctcatcaataacatcctgatatattttgcagcttgcatatttggtggtgttcctctgtctggaatcattttgtcttacactcagatcacctcctgtgttttgagaatgccatcagcaagtggaaagcacaaagcagtttccacctgtgggtctcacctctccattgttctcttgttctatggggcaggtttgggggtgtacattagttctgtggttactgactcacctaggaagactgcagtggcttcagtgatgtattctgtgttccctcaaatggtgaacccctttatctatagtctgaggaataaggacatgaaaggaaccttgaggaagttcatagggaggataccttctcttctgtggtgtgccatttgctttggattcaggtttctagagtaa

SEQ ID NO: 162475 - DNA, 939 bp, Homo sapiens
  Payload ID: 11975
  Gene Symbol: OR7G3
  Gene Name: olfactory receptor, family 7, subfamily G, member 3
  Uniprot ID: Q8NG95
  ENST ID: ENST00000305444
  CDS Start-End: 1-939
atgaaagcaggaaacttctcagacactccagaattctttctcttgggattgtcaggggatccggagctgcagcccatcctcttcatgctgttcctgtccatgtacctggccacaatgctggggaacctgctcatcatcctggccgtcaactctgactcccacctccacacccccatgtacttcctcctctctatcctgtccttggtcgacatctgtttcacctccaccacgatgcccaagatgctggtgaacatccaggcacaggctcaatccatcaattacacaggctgcctcacccaaatctgctttgtcctggtttttgttggattggaaaatggaattctggtcatgatggcctatgatcgatttgtggccatctgtcacccactgaggtacaatgtcatcatgaaccccaaactctgtgggctgctgcttctgctgtccttcatcgttagtgtcctggatgctctgctgcacacgttgatggtgctacagctgaccttctgcatagacctggaaattccccactttttctgtgaactagctcatattctcaagctcgcctgttctgatgtcctcatcaataacatcctggtgtatttggtgaccagcctgttaggtgttgttcctctctctgggatcattttctcttacacacgaattgtctcctctgtcatgaaaattccatcagctggtggaaagtataaagctttttccatctgcgggtcacatttaatcgttgtttccttgttttatggaacagggtttggggtgtaccttagttctggggctacccactcctccaggaagggtgcaatagcatcagtgatgtataccgtggtcacccccatgctgaacccactcatttacagcctgagaaacaaggacatgttgaaggctttgaggaaactaatatctaggataccatctttccattga

SEQ ID NO: 162476 - DNA, 1146 bp, Homo sapiens
  Payload ID: 11976
  Gene Symbol: OR8A1
  Gene Name: olfactory receptor, family 8, subfamily A, member 1
  Uniprot ID: Q8NGG7
  ENST ID: ENST00000284287
  CDS Start-End: 73-1053
catcagcagagagcccaggatgtttcactagcaccaaaggctcaagactagccgtccaagattagccttttaatggggttcttgtctcccatgcatccctgcaggcctcccacccagaggagaatggctgcaggaaatcactctacagtgacagagttcattctcaagggtttaacgaagagagcagacctccagctccccctctttctcctcttcctcgggatctacttggtcaccatcgtggggaacctgggcatgatcactctaatttgtctgaactctcagctgcacacccccatgtactactttctcagcaatctgtcactcatggatctctgctactcctccgtcattacccctaagatgctggtgaactttgtgtcagagaaaaacatcatctcctacgcagggtgcatgtcacagctctacttcttccttgtttttgtcattgctgagtgttacatgctgacagtgatggcctacgaccgctatgttgccatctgccaccctttgctttacaacatcattatgtctcatcacacctgcctgctgctggtggctgtggtctacgccatcggactcattggctccacaatagaaactggcctcatgttaaaactgccctattgtgagcacctcatcagtcactacttctgtgacatcctccctctcatgaagctgtcctgctctagcacctatgatgttgagatgacagtcttcttttcggctggattcaacatcatagtcacgagcttaacagttcttgtttcttacaccttcattctctccagcatcctcggcatcagcaccacagaggggagatccaaagccttcagcacctgcagctcccaccttgcagccgtgggaatgttctatggatcaactgcattcatgtacttaaaaccctccacaatcagttccttgacccaggagaatgtggcctctgtgttctacaccacggtaatccccatgttgaatcccctaatctacagcctgaggaacaaggaagtaaaggctgccgtgcagaaaacgctgaggggtaaactgttttgatgcaaatgttattgttccttttcaatttagtggtaattgttataaataccagagtgacagcttctgaatgctggccagctgtggatggaaaat

SEQ ID NO: 162477 - DNA, 998 bp, Homo sapiens
  Payload ID: 11977
  Gene Symbol: OR8B12
  Gene Name: olfactory receptor, family 8, subfamily B, member 12
  Uniprot ID: Q8NGG6
  ENST ID: ENST00000306842
  CDS Start-End: 26-958
cgactctcctgcctgaccaaaaagaatggcagccaaaaactcttctgtgacagagtttatcctcgaaggcttaacccaccagccgggactgcggatccccctcttcttcctgtttctgggtttctacacggtcaccgtggtggggaacctgggcttgataaccctgattgggctgaactctcacctgcacactcccatgtacttcttcctttttaacctctctttaatagatttctgtttctccactaccatcactcccaaaatgctgatgagttttgtctcaaggaagaacatcatttccttcacagggtgtatgactcagctcttcttcttctgcttctttgtcgtctctgagtccttcatcctgtcagcgatggcgtatgaccgctacgtggccatctgtaacccactgttgtacacagtcaccatgtcttgccaggtgtgtttgctccttttgttgggtgcctatgggatggggtttgctggggccatggcccacacaggaagcataatgaacctgaccttctgtgctgacaaccttgtcaatcatttcatgtgtgacatccttcctctccttgagctctcctgcaacagctcttacatgaatgagctggtggtctttattgtggtggctgttgacgttggaatgcccattgtcactgtctttatttcttatgccctcatcctctccagcattctacacaacagttctacagaaggcaggtccaaagcctttagtacttgcagttcccacataattgtagtttctcttttctttggttctggtgctttcatgtatctcaaacccctttccatcctgcccctcgagcaagggaaagtgtcctccctgttctataccataatagtccccgtgttaaacccattaatctatagcttgaggaacaaggatgtcaaagttgccctgaggagaactttgggcagaaaaatcttttcttaagaaaggattagtattggaggaaggagatacaatgctttgc

SEQ ID NO: 162478 - DNA, 968 bp, Homo sapiens
  Payload ID: 11978
  Gene Symbol: OR8B2
  Gene Name: olfactory receptor, family 8, subfamily B, member 2
  Uniprot ID: Q96RD0
  ENST ID: ENST00000375013
  CDS Start-End: 20-961
agatttttgaagacaaaaaatgctggctagaaacaactccttagtgactgaatttattcttgctggattaacagatcatccagagttccggcaacccctctttttcctgtttctagtgatctacattgtcaccatggtaggcaaccttggcttgatcactcttttcggtctaaattctcacctccacacaccaatgtactatttcctcttcaatctctccttcattgatctctgttactcctctgttttcactcccaaaatgctaatgaactttgtgtcaaaaaagaatattatctccaatgttgggtgcatgactcggctgtttttctttctctttttcgtcatctctgaatgttacatgttgacttcaatggcatatgatcgctatgtggccatctgtaatccattgctgtataaggtcaccatgtcccatcaggtctgttctatgctcacttttgctgcttacataatgggattggctggagccacggcccacaccgggtgcatgcttagactcaccttctgcagtgctaatatcatcaaccattacttgtgtgacatactccccctcctccagctttcctgcaccagcacctatgtcaacgaggtggttgttctcattgttgtgggtactaatatcacggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagtttcttctgttttctacactaatgtggtgcccatgctcaatcccctcatctacagtttgaggaacaaggatgtcaaagttgcactgaggaaagctctgattaaaattcagaggagaaatatattctaattagaag

SEQ ID NO: 162479 - DNA, 987 bp, Homo sapiens
  Payload ID: 11979
  Gene Symbol: OR8B3
  Gene Name: olfactory receptor, family 8, subfamily B, member 3
  Uniprot ID: Q8NGG8
  ENST ID: ENST00000354597
  CDS Start-End: 18-959
atttttgaagacaaaaaatgctggctagaaacaactccttagtgactgaatttattcttgctggattaacagatcatccagagttccagcaacccctctttttcctgtttctagtggtctacattgtcaccatggtaggcaaccttggcttgatcattcttttcggtctaaattctcacctccacacaccaatgtactatttcctcttcaatctctccttcattgatctctgttactcctctgttttcactcccaaaatgctaatgaactttgtatcaaaaaagaatattatctcctatgttgggtgcatgactcagctgtttttctttctcttttttgtcatctctgaatgttacatgttgacctcaatggcatatgatcgctatgtggccatctgtaatccattgctgtataaggtcaccatgtcccatcaggtctgttctatgctcacttttgctgcttacataatgggattggctggagccacggcccacaccgggtgcatgcttagactcaccttctgcagtgctaatatcatcaaccattacttgtgtgacatactccccctcctccagctttcctgcaccagcacctatgtcaacgaggtggttgttctcattgttgtgggtattaatatcatggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagtttcttctgttttctacactaatgtggtgcccatgctcaatcctctcatctacagtttgaggaacaaggatgtcaaagttgcactgaggaaagctctgattaaaattcagagaagaaatatattctaattagaagcagtaataatgtaaaacgatt

SEQ ID NO: 162480 - DNA, 930 bp, Homo sapiens
  Payload ID: 11980
  Gene Symbol: OR8B4
  Gene Name: olfactory receptor, family 8, subfamily B, member 4 (gene/pseudogene)
  Uniprot ID: Q96RC9
  ENST ID: ENST00000624268
  CDS Start-End: 1-930
atgactctgagaaacagctcctcagtgactgagtttatccttgtgggattatcagaacagccagagctccagctccctcttttccttctattcttagggatctatgtgttcactgtggtgggcaacttgggcttgatcaccttaattgggataaatcctagccttcacacccccatgtactttttcctcttcaacttgtcctttatagatctctgttattcctgtgtgtttacccccaaaatgctgaatgactttgtttcagaaagtatcatctcttatgtgggatgtatgactcagctatttttcttctgtttctttgtcaattctgagtgctatgtgttggtatcaatggcctatgatcgctatgtggccatctgcaaccccctgctctacatggtcaccatgtccccaagggtctgctttctgctgatgtttggttcctatgtggtagggtttgctggggccatggcccacactggaagcatgctgcgactgaccttctgtgattccaacgtcattgaccattatctgtgtgacgttctccccctcttgcagctctcctgcaccagcacccatgtcagtgagctggtatttttcattgttgttggagtaatcaccatgctatccagcataagcatcgtcatctcttacgctttgatactctccaacatcctctgtattccttctgcagagggcagatccaaagcctttagcacatggggctcccacataattgctgttgctctgttttttgggtcagggacattcacctacttaacaacatcttttcctggctctatgaaccatggcagatttgcctcagtcttttacaccaatgtggttcccatgcttaacccttcgatctacagtttgaggaataaggatgataaacttgccctgggcaaaaccctgaagagagtgctcttctaa

SEQ ID NO: 162481 - DNA, 1033 bp, Homo sapiens
  Payload ID: 11981
  Gene Symbol: OR8B8
  Gene Name: olfactory receptor, family 8, subfamily B, member 8
  Uniprot ID: Q15620
  ENST ID: ENST00000328064
  CDS Start-End: 74-1009
ggagggcagcagtggtctctctctctctctaaataactttttcccttgtccccacagaatgccttaaatgacaatggctgctgagaattcctccttcgtgacacagtttatcctcgcaggcttaactgaccaaccgggagtccagatccccctcttcttcctgtttctaggcttctacgtggtcactgtggtggggaacctgggcttgataaccctgataaggctcaactctcacttgcacacccctatgtacttcttcctctataacttgtccttcatagatttctgctattccagtgttatcactcccaaaatgctgatgagctttgtcttaaagaagaacagcatctcctacgcagggtgtatgactcagctcttcttctttcttttctttgttgtctctgagtccttcatcctgtcagcaatggcgtatgaccgctatgtggccatctgtaacccactgttgtacatggtcaccatgtctccccaggtgtgttttctccttttgttgggtgtctatgggatggggtttgctggggccatggcccacacagcgtgcatgatgggtgtgaccttctgtgccaataaccttgtcaaccactacatgtgtgacatccttccccttcttgagtgtgcttgcaccagcacctatgtgaatgagcttgtagtgtttgttgttgtgggcattgatattggtgtgcccacagtcaccatcttcatttcctatgctctcattctctccagcatcttccacattgattccacggagggcaggtccaaagccttcagcacctgcagctcccacataattgcagtttctctgttctttgggtcaggagcattcatgtacctcaaacccttttctcttttagctatgaaccagggcaaggtgtcttccctattctataccactgtggtgcccatgctcaacccattaatttatagcctgaggaataaggacgtcaaagttgctctaaagaaaatcttgaacaaaaatgcattctcctgagaaaagggcaatgctcaggaaaga

SEQ ID NO: 162482 - DNA, 1026 bp, Homo sapiens
  Payload ID: 11982
  Gene Symbol: OR8D1
  Gene Name: olfactory receptor, family 8, subfamily D, member 1
  Uniprot ID: Q8WZ84
  ENST ID: ENST00000357821
  CDS Start-End: 72-998
ttggaagagcagtgagggtccatgttaaggtaattcatactttctattttcacagaaatgcctaaagaagaatgaccatggaaaattattctatggcagctcagtttgtcttagatggtttaacacagcaagcagagctccagctgcccctcttcctcctgttcctgggaatctatgtggtcacagtagtgggcaacctgggcatgattctcctgattgcagtcagccctctacttcacacccccatgtactatttcctcagcagcttgtccttcgtcgatttctgctattcctctgtcattactcccaaaatgctggtgaacttcctaggaaagaagaatacaatcctttactctgagtgcatggtccagctctttttctttgtggtctttgtggtggctgagggttacctcctgactgccatggcatatgatcgctatgttgccatctgtagcccactgctttataatgcgatcatgtcctcatgggtctgctcactgctagtgctggctgccttcttcttgggctttctctctgccttgactcatacaagtgccatgatgaaactgtccttttgcaaatcccacattatcaaccattacttctgtgatgttcttcccctcctcaatctctcctgctccaacacacacctcaatgagcttctactttttatcattgcggggtttaacaccttggtgcccaccctagctgttgctgtctcctatgccttcatcctctacagcatccttcacatccgctcctcagagggccggtccaaagcttttggaacatgcagctctcatctcatggctgtggtgatcttctttgggtccattaccttcatgtatttcaagcccccttcaagtaactccctggaccaggagaaggtgtcctctgtgttctacaccacggtgatccccatgctgaaccctttaatatacagtctgaggaataaggatgtgaagaaagcattaaggaaggtcttagtaggaaaatgagtcctgatttgggggatttatagatggg

SEQ ID NO: 162483 - DNA, 936 bp, Homo sapiens
  Payload ID: 11983
  Gene Symbol: OR8D2
  Gene Name: olfactory receptor, family 8, subfamily D, member 2 (gene/pseudogene)
  Uniprot ID: Q9GZM6
  ENST ID: ENST00000357438
  CDS Start-End: 1-936
atggctacttcaaaccattcttcaggggctgagtttatcctggcaggcttgacacaacgcccagaacttcaactgccactcttcctcctgttccttggaatatatgtggtcacagtggtggggaacctgggcatgatcttcttaattgctctcagttctcaactttaccctccagtgtattattttctcagtcatttgtctttcattgatctctgctactcctctgtcattacccctaagatgctggtgaactttgttccagaggagaacattatctcctttctggaatgcattactcaactttatttcttccttatttttgtaattgcagaaggctaccttctgacagccatggaatatgaccgttatgttgctatctgtcgcccactgctttacaatattgtcatgtcccacagggtctgttccataatgatggctgtggtatactcactgggttttctgtgggccacagtccatactacccgcatgtcagtgttgtcattctgtaggtctcatacggtcagtcattatttttgtgatattctccccttattgactctgtcttgctccagcacccacatcaatgagattctgctgttcattattggaggagttaataccttagcaactacactggcggtccttatctcttatgctttcattttctctagtatccttggtattcattccactgaggggcaatccaaagcctttggcacttgtagctcccatctcttggctgtgggcatcttttttgggtctataacattcatgtatttcaagcccccttccagcactactatggaaaaagagaaggtgtcttctgtgttctacatcacaataatccccatgctgaatcctctaatctatagcctgaggaacaaggatgtgaaaaatgcactgaagaagatgactaggggaaggcagtcatcctga

SEQ ID NO: 162484 - DNA, 936 bp, Homo sapiens; identical to SEQ ID NO: 162483
  Payload ID: 11983
  Gene Symbol: OR8D2
  Gene Name: olfactory receptor, family 8, subfamily D, member 2 (gene/pseudogene)
  Uniprot ID: Q9GZM6
  ENST ID: ENST00000624877
  CDS Start-End: 1-936

SEQ ID NO: 162485 - DNA, 1051 bp, Homo sapiens
  Payload ID: 11983
  Gene Symbol: OR8D2
  Gene Name: olfactory receptor, family 8, subfamily D, member 2 (gene/pseudogene)
  Uniprot ID: Q9GZM6
  ENST ID: ENST00000624618
  CDS Start-End: 92-1027
tggggcatgtcattctgctttgggaatcagaaaataaatctaatgtctctcttttctcttatttcttattacacataataccttaaaagacatggctacttcaaaccattcttcaggggctgagtttatcctggcaggcttgacacaacgcccagaacttcaactgccactcttcctcctgttccttggaatatatgtggtcacagtggtggggaacctgggcatgatcttcttaattgctctcagttctcaactttaccctccagtgtattattttctcagtcatttgtctttcattgatctctgctactcctctgtcattacccctaagatgctggtgaactttgttccagaggagaacattatctcctttctggaatgcattactcaactttatttcttccttatttttgtaattgcagaaggctaccttctgacagccatggaatatgaccgttatgttgctatctgtcgcccactgctttacaatattgtcatgtcccacagggtctgttccataatgatggctgtggtatactcactgggttttctgtgggccacagtccatactacccgcatgtcagtgttgtcattctgtaggtctcatacggtcagtcattatttttgtgatattctccccttattgactctgtcttgctccagcacccacatcaatgagattctgctgttcattattggaggagttaataccttagcaactacactggcggtccttatctcttatgctttcattttctctagtatccttggtattcattccactgaggggcaatccaaagcctttggcacttgtagctcccatctcttggctgtgggcatcttttttgggtctataacattcatgtatttcaagcccccttccagcactactatggaaaaagagaaggtgtcttctgtgttctacatcacaataatccccatgctgaatcctctaatctatagcctgaggaacaaggatgtgaaaaatgcactgaagaagatgactaggggaaggcagtcatcctgacaaagagggttctcattggcagcc

SEQ ID NO: 162486 - DNA, 1331 bp, Homo sapiens
  Payload ID: 11984
  Gene Symbol: OR8D4
  Gene Name: olfactory receptor, family 8, subfamily D, member 4
  Uniprot ID: Q8NGM9
  ENST ID: ENST00000321355
  CDS Start-End: 287-1231
ttttaagcattagttttgtctctaactctggagtaaaaggttctgtcgtttgctaagagaatttgttccactggagggtatggaaaagtgtgtttctggttcctaaaatctataggtaggtagatgcttaccgactccatttcatctgagtgttcactttttggttttcgtaacacaaagtcagtgttttcatagagagaaaacactgatatttgttttctatagaaacaaacactgatagaatttgactttttctctctcatctccacagatttctcagagaagaatgggtgtaaaaaaccattccacagtgactgagtttcttctttcaggattaactgaacaagcagagcttcagctgcccctcttctgcctcttcttaggaatttacacagttactgtggtgggaaacctcagcatgatctcaattattaggctgaatcgtcaacttcatacccccatgtactatttcctgagtagtttgtcttttttagatttctgctattcttctgtcattacccctaaaatgctatcagggtttttatgcagagatagatccatctcctattctggatgcatgattcagctgttttttttctgtgtttgtgttatttctgaatgctacatgctggcagccatggcctgcgatcgctacgtggccatctgcagcccactgctctacagggtcatcatgtcccctagggtctgttctctgctggtggctgctgtcttctcagtaggtttcactgatgctgtgatccatggaggttgtatactcaggttgtctttctgtggatcaaacatcattaaacattatttctgtgacattgtccctcttattaaactctcctgctccagcacttatattgatgagcttttgatttttgtcattggtggatttaacatggtggccacaagcctaacaatcattatttcatatgcttttatcctcaccagcatcctgcgcatccactctaaaaagggcaggtgcaaagcgtttagcacctgtagctcccacctgacagctgttcttatgttttatgggtctctgatgtccatgtatctcaaacctgcttctagcagttcactcacccaggagaaagtatcctcagtattttataccactgtgattctcatgttgaatcccttgatatatagtctgaggaacaatgaagtaagaaatgctctgatgaaacttttaagaagaaaaatatctttatctccaggataaatatgctctttattaagatctatttctgtattcataatcatgattatatgtatatatttataccttgactatttaaaagtaatttgaggtccaggtacgg

SEQ ID NO: 162487 - DNA, 936 bp, Homo sapiens
  Payload ID: 11985
  Gene Symbol: OR8G1
  Gene Name: olfactory receptor, family 8, subfamily G, member 1 (gene/pseudogene)
  Uniprot ID: Q15617
  ENST ID: ENST00000341493
  CDS Start-End: 1-936
atgtcaggagaaaataattcctcagtgactgagttcattctggctgggctctcagaacagccagagctccagctgcccctcttcctcctgttcttaggaatctatgtggtcacagtggtgggcaacctgggcatgaccacactgatttggctcagttctcacctgcacacccctatgtactatttcctcagcagtctgtccttcattgacttctgccattccactgtcattacccctaagatgctggtgaactttgtgacagagaagaacatcatctcctaccctgaatgcatgactcagctctacttcttcctcgtttttgctattgcagagtgtcacatgttggctgcaatggcgtatgaccgttacatggccatctgtagccccttgctgtacagtgtcatcatatccaataaggcttgcttttctctgattttaggggtgtatataataggcctggtttgtgcatcagttcatacaggctgtatgtttagggttcaattctgcaaatttgatttgattaaccattatttctgtgatcttcttcccctcctaaagctctcttgctctagtatctatgtcaacaaactacttattctatgtgttggtgcatttaacatccttgtccccagcctgaccatcctttgctcttacatctttattattgccagcatcctccacattcgctccactgagggcaggtccaaagccttcagcacttgtagctcccacatgttggcggttgtaatcttttttggatctgcagcattcatgtacttgcagccatcttcaatcagctccatggaccaggggaaagtatcctctgtgttttatactattattgtgcccatgttgaaccctctgatttatagcctgaggaataaagatgtccatgtttccctgaagaaaatgctacagagaagaacattattgtaa

SEQ ID NO: 162488 - DNA, 1041 bp, Homo sapiens
  Payload ID: 11986
  Gene Symbol: OR8G5
  Gene Name: olfactory receptor, family 8, subfamily G, member 5
  Uniprot ID: Q8NG78
  ENST ID: ENST00000524943
  CDS Start-End: 1-1041
atgatcatatataaacaagggatcactttcctacaaaaggagaataacaatacaattcacctaaataccatgttttttctctcccctgcagaaactcatcaaagaatggcagcagaaaaccattcttttgtgactaagtttattctggttgggctaacagagaagtcagagctacagctgcccctcttcctcgtcttcctgggaatctatgtagtcacagtgctggggaacctgggcatgatcacactgattgggctcagttctcacctgcacacacctatgtactgtttcctcagcagtctgtccttcattgacttctgccattccactgtcattacccctaagatgctggtgaactttgtgacagagaagaacatcatctcctaccctgaatgcatgactcagctctacttcttcctcgtttttgctattgcagagtgtcacatgttggctgcaatggcatatgacggctacgtggccatctgtagccccttgctgtacagcatcatcatatccaataaggcttgcttttctctgattttagtggtgtatgtaataggcctgatttgtgcgtcagctcatataggctgtatgtttagggttcaattctgcaaatttgatgtgatcaaccattatttctgtgatcttatttctatcttgaagctctcctgttctagtacttacattaatgagttactgattttaatctttagtggaattaacatccttgtccccagcctgaccatcctcagctcttacatcttcatcattgccagcatcctccgcattcgctacactgagggcaggtccaaagccttcagcacttgcagctcccacatctcggctgtttctgttttctttgggtctgcagcattcatgtacctgcagccatcatctgtcagctccatggaccaggggaaagtgtcctctgtgttttatactattgttgtgcccatgctgaaccccctgatctacagcctgaggaataaagatgtccacgttgccctgaagaaaacgctagggaaaagaacattcttatga

SEQ ID NO: 162489 - DNA, 1038 bp, Homo sapiens
  Payload ID: 11987
  Gene Symbol: OR8H1
  Gene Name: olfactory receptor, family 8, subfamily H, member 1
  Uniprot ID: Q8NGG4
  ENST ID: ENST00000313022
  CDS Start-End: 29-964
tctcagcagtttaaagcaattgaacatcatgggtagaagaaataacacaaatgtgcctgacttcatccttacgggactgtcagattctgaagaggtccagatggccctctttatactatttctcctgatatacctaattactatgctgggcaatgtggggatgatattgataatccgcctggacctccagcttcacactcccatgtattttttccttactcacttgtcatttattgacctcagttactcaactgtcatcacacctaaaaccttagcgaacttactgacttccaactatatttccttcatgggctgctttgcccagatgttcttttttgtcttcttgggagctgctgaatgttttcttctctcatcaatggcctatgatcgctacgtagctatctgcagtcctctacgttacccagttattatgtccaaaaggctgtgttgcgctcttgtcactgggccctatgtgattagctttatcaactcctttgtcaatgtggtttggatgagcagactgcatttctgcgactcaaatgtagttcgtcactttttctgcgacacgtctccaattttagctctgtcctgcatggacacatacgacattgaaatcatgatacacattttagctggttccaccctgatggtgtcccttatcacaatatctgcatcctatgtgtccattctctctaccatcctgaaaattaattccacttcaggaaagcagaaagctttgtctacttgtgcctctcatctcttgggagtcaccatcttttatggaactatgatttttacttatttaaaaccaagaaagtcttattctttgggaagggatcaagtggcttctgttttttatactattgtgattcccatgctgaatccactcatttatagtcttagaaacaaagaagttaaaaatgctctcattagagtcatgcagagaagacaggactccaggtaattaaaatagcaggaatgctgaacatttaaactcatcttttctttcttttctatttggtatgtccttggtctccc

SEQ ID NO: 162490 - DNA, 927 bp, Homo sapiens
  Payload ID: 11987
  Gene Symbol: OR8H1
  Gene Name: olfactory receptor, family 8, subfamily H, member 1
  ENST ID: ENST00000574192
  CDS Start-End: 1-927
aataacacaaatgtgcctgacttcatccttacgggactgtcagattctgaagaggtccagatggccctctttatactatttctcctgatatacctaattactatgctgggcaatgtggggatgatattgataatccgcctggacctccagcttcacactcccatgtattttttccttactcacttgtcatttattgacctcagttactcaactgtcatcacacctaaaaccttagcgaacttactgacttccaactatatttccttcatgggctgctttgcccagatgttcttttttgtcttcttgggagctgctgaatgttttcttctctcatcaatggcctatgatcgctacgtagctatctgcagtcctctacgttacccagttattatgtccaaaaggctgtgttgcgctcttgtcactgggccctatgtgattagctttatcaactcctttgtcaatgtggtttggatgagcagactgcatttctgcgactcaaatgtagttcgtcactttttctgcgacacgtctccaattttagctctgtcctgcatggacacatacgacattgaaatcatgatacacattttagctggttccaccctgatggtgtcccttatcacaatatctgcatcctatgtgtccattctctctaccatcctgaaaattaattccacttcaggaaagcagaaagctttgtctacttgtgcctctcatctcttgggagtcaccatcttttatggaactatgatttttacttatttaaaaccaagaaagtcttattctttgggaagggatcaagtggcttctgttttttatactattgtgattcccatgctgaatccactcatttatagtcttagaaacaaagaagttaaaaatgctctcattagagtcatgcagagaatttggtatgtccttggtctc

SEQ ID NO: 162491 - DNA, 927 bp, Homo sapiens; identical to SEQ ID NO: 162490
  Payload ID: 11987
  Gene Symbol: OR8H1
  Gene Name: olfactory receptor, family 8, subfamily H, member 1
  ENST ID: ENST00000610894
  CDS Start-End: 1-927

SEQ ID NO: 162492 - DNA, 1038 bp, Homo sapiens; identical to SEQ ID NO: 162489
  Payload ID: 11987
  Gene Symbol: OR8H1
  Gene Name: olfactory receptor, family 8, subfamily H, member 1
  Uniprot ID: Q8NGG4
  ENST ID: ENST00000626711
  CDS Start-End: 29-964

SEQ ID NO: 162493 - DNA, 939 bp, Homo sapiens
  Payload ID: 11988
  Gene Symbol: OR8H2
  Gene Name: olfactory receptor, family 8, subfamily H, member 2
  Uniprot ID: Q8N162
  ENST ID: ENST00000313503
  CDS Start-End: 1-939
atgatgggtagaaggaataacacaaatgtggctgacttcatccttatgggactgacactttctgaagagatccagatggctctgtttatgctatttctcctgatatacctaattactatgctggggaatgtggggatgatattgataatccgcctggacctccagcttcacactcccatgtattttttccttactcacctgtcatttattgacctcagttactcaactgtcgtcacacctaaaaccttagcgaacttactgacttccaactatatttcctttacgggctgctttgcccagatgttcttttttgccttcttgggtactgctgaatgttaccttctctcctcaatggcccatgatcgctatgcagcgatctgcagtcctctacactacacagttattatgtccaaaaggctctgcctcgctctcatcactgggccttatgtgattggctttatagactcctttgtcaacgtggtttccatgagcagattgcatttctacgactcaaacgtaattcatcactttttctgtgacacttccccaattttagctctgtcctgcactgatacatacaacaccgaaatcctgatattcattattgttggttccaccctgatggtgtcccttttcacaatatctgcatcctatgtgttcattctctttaccatcctgaaaattaattccacttcaggaaagcagaaagctttctctacttgcgtctctcatctcttgggagtcaccatcttttatagcactctgatttttacttatttaaaaccaagaaagtcttattccttgggaagagatcaagtggcttctgttttttatactattgtgattcccgtgctgaatccactcatttatagtcttagaaacaaagaggtgaaaaatgctgtcatcagagtcatgcagagaagacaggactccaggtaa

SEQ ID NO: 162494 - DNA, 1038 bp, Homo sapiens
  Payload ID: 11988
  Gene Symbol: OR8H2
  Gene Name: olfactory receptor, family 8, subfamily H, member 2
  ENST ID: ENST00000618136
  CDS Start-End: 29-964
tctcagcagtttagagcaggtgaacatgatgggtagaaggaataacacaaatgtggctgacttcatccttatgggactgacactttctgaagagatccagatggctctgtttatgctatttctcctgatatacctaattactatgctggggaatgtggggatgatattgataatccgcctggacctccagcttcacactcccatgtattttttccttactcacctgtcatttattgacctcagttactcaactgtcgtcacacctaaaaccttagcgaacttactgacttccaactatatttcctttacgggctgctttgcccagatgttcttttttgccttcttgggtactgctgaatgttaccttctctcctcaatggcccatgatcgctatgcagcgatctgcagtcctctacactacacagttattatgtccaaaaggctctgcctcgctctcatcactgggccttatgtgattggctttatagactcctttgtcaacgtggtttccatgagcagattgcatttctacgactcaaacgtaattcatcactttttctgtgacacttccccaattttagctctgtcctgcactgatacatacaacaccgaaatcctgatattcattattgttggttccaccctgatggtgtcccttttcacaatatctgcatcctatgtgttcattctctttaccatcctgaaaattaattccacttcaggaaagcagaaagctttctctacttgcgtctctcatctcttgggagtcaccatcttttatagcactctgatttttacttatttaaaaccaagaaagtcttattccttgggaagagatcaagtggcttctgttttttatactattgtgattcccgtgctgaatccactcatttatagtcttagaaacaaagaggtgaaaaatgctgtcatcagagtcatgcagagaagacaggactccaggtaattaatatagcaggaatgctgaacatttaaactcatcttttctttcattcctgttgggtattttcttagtctctc

SEQ ID NO: 162495 - DNA, 939 bp, Homo sapiens
  Payload ID: 11989
  Gene Symbol: OR8H3
  Gene Name: olfactory receptor, family 8, subfamily H, member 3
  Uniprot ID: Q8N146
  ENST ID: ENST00000313472
  CDS Start-End: 1-939
atgatgggtagaaggaatgacacaaatgtggctgacttcatccttacgggactgtcagactctgaagaggtccagatggctctgtttatgctatttctcctcatatacctaattactatgctggggaatgtggggatgctattgataatccgcctggacctccagcttcacactcccatgtattttttccttactcacctgtcatttattgacctcagttactcaactgtcgtcacacctaaaaccttagcgaacttactgacttccaactatatttccttcacgggctgctttgcccagatgttctgttttgtcttcttgggtactgctgaatgttatcttctctcctcaatggcctatgatcgctatgcagcgatctgcagtcctctacactacacagttattatgcccaaaaggctctgcctcgctctcatcactgggccttatgtgattggctttatggactcctttgtcaatgtggtttccatgagcagattgcatttctgtgactcaaacataattcatcactttttctgtgacacttccccaattttagctctgtcctgcactgacacagacaacactgaaatgctgatattcattatcgctggttccaccctgatggtgtcccttatcacaatatctgcatcctatgtgtccattctctctaccatcctgaaaattaattccacttcaggaaagcagaaagctttctctacttgcgtctctcatctcttgggagtcaccatcttctatggaactatgatttttacttacttaaagccaagaaagtcttattccttgggaagagatcaagtggctcctgtgttttatactattgtgattcccatgctgaatccactcatttatagtcttagaaacagagaagtgaaaaatgctctcattagagtcatgcagagaagacaggactccaggtag

SEQ ID NO: 162496 - DNA, 933 bp, Homo sapiens
  Payload ID: 11990
  Gene Symbol: OR8I2
  Gene Name: olfactory receptor, family 8, subfamily I, member 2
  Uniprot ID: Q8N0Y5
  ENST ID: ENST00000302124
  CDS Start-End: 1-933
atggctggcaacaatttcactgaggttaccgtcttcatcctctctggatttgcaaatcaccctgaattacaagtcagtcttttcttgatgtttctcttcatttatctattcactgttttgggaaacctgggactgatcacgttaatcagaatggattctcagcttcacacccctatgtactttttcctgagcaatttagcatttattgacatattttactcctctactgtaacacctaaggcattggtgaatttccaatccaatcggagatccatctcctttgttggctgctttgttcaaatgtacttttttgttggattggtgtgttgtgagtgtttccttctgggatcaatggcctacaatcgctacatagcaatctgcaatcccttactgtattcagtagtcatgtcccaaaaagtgtccaactggctgggagtaatgccatatgtgataggcttcacaagctcgctgatatctgtctgggtgataagcagtttggcgttctgtgattccagcatcaatcattttttttgtgacaccacagctcttttagcactctcctgtgtagatacattcggcacagaaatggtgagctttgtcttagctggattcactcttcttagctctctccttatcatcacagtcacttatatcatcatcatctcagccatcctgaggatccagtcagcagcaggcaggcagaaggccttctccacctgcgcatcccacctcatggctgtaactatcttttatgggtctctgattttcacctatttgcaacctgataacacatcatcgctgacccaggcgcaggtggcatctgtattctatacgattgtcattcccatgctgaatccactcatctacagtctgaggaacaaagatgtgaaaaatgctcttctgagagtcatacatagaaaactttttccatga

SEQ ID NO: 162497 - DNA, 933 bp, Homo sapiens; identical to SEQ ID NO: 162496
  Payload ID: 11990
  Gene Symbol: OR8I2
  Gene Name: olfactory receptor, family 8, subfamily I, member 2
  ENST ID: ENST00000618695
  CDS Start-End: 1-553

SEQ ID NO: 162498 - DNA, 1074 bp, Homo sapiens
  Payload ID: 11991
  Gene Symbol: OR8J1
  Gene Name: olfactory receptor, family 8, subfamily J, member 1
  Uniprot ID: Q8NGP2
  ENST ID: ENST00000303039
  CDS Start-End: 33-983
tcccccaaacagatgaatttccaaactctgacatggctcctgaaaatttcaccagagtcactgagtttattcttacaggtgtctctagctgtccagagctccagattcccctcttcctggtctttctggtgctctatgggctgaccatggcagggaacctgggcatcatcaccctcaccagtgttgactctcgacttcaaacccccatgtactttttcctgcaacatctggctctcattaatcttggtaactctactgtcattgcccctaaaatgctgattaactttttagtaaagaagaaaactacctcattctatgaatgtgccacccaactgggagggttcttgttctttattgtatcggaggtaatcatgctggctttgatggcctatgaccgctatgtggctatttgtaaccctctgctgtacatggtggtggtgtctcggcggctctgcctcctgctggtctccctcacatacctctatggcttttctacagctattgtggtttcatcttatgtattctctgtgtcttattgctcttctaatataatcaatcatttttactgtgataatgttcctctgttagcattatcttgctctgatacttacttaccagaaacagttgtctttatatctgcagcaacaaatgtggttggttccttgattatagttctagtatcttatttcaatattgttttgtctattttaaaaatatgttcatcagaaggaaggaaaaaagccttttctacctgtgcttcacatatgatggcagtcacaattttttatgggacattgctattcatgtatgtgcagccccgaagtaaccattcactggatactgatgataagatggcttctgtgttttacacgttggtaattcctatgctgaatcccttgatctacagcctgaggaataaggatgtgaagactgctctacagagattcatgacaaatctgtgctattcctttaaaacaatgtaattttaaacagtacaggtaaatgaggagagagttaatataagctgccattatgtaaaagaaaatgtaggaaaaagaaaaggtaggtagccga

SEQ ID NO: 162499 - DNA, 1074 bp, Homo sapiens
  Payload ID: 11991
  Gene Symbol: OR8J1
  Gene Name: olfactory receptor, family 8, subfamily J, member 1
  Uniprot ID: Q8NGP2
  ENST ID: ENST00000574644
  CDS Start-End: 33-983
tcccccaaacagatgaatttccaaactctgacatggctcctgaaaatttcaccagggtcactgagtttattcttacaggtgtctctagctgtccagagctccagattcccctcttcctggtctttctggtgctctatgggctgaccatggcagggaacctgggcatcatcaccctcaccagtgttgactctcgacttcaaacccccatgtactttttcctgcaacatctggctctcattaatcttggtaactctactgtcattgcccctaaaatgctgattaactttttagtaaagaagaaaactacctcattctatgaatgtgccacccaactgggagggttcttgttctttattgtatcggaggtaatcatgctggctttgatggcctatgaccgctatgtggctatttgtaaccctctgctgtacatggtggtggtgtctcggcggctctgcctcctgctggtctccctcacatacctctatggcttttctacagctattgtggtttcatcttatgtattctctgtgtcttattgctcttctaatataatcaatcatttttactgtgataatgttcctctgttagcattatcttgctctgatacttacttaccagaaacagttgtctttatatctgcagcaacaaatgtggttggttccttgattatagttctagtatcttatttcaatattgttttgtctattttaaaaatatgttcatcagaaggaaggaaaaaagccttttctacctgtgcttcacatatgatggcagtcacaattttttatgggacattgctattcatgtatgtgcagccccgaagtaaccattcattggatactgatgataagatggcttctgtgttttacacgttggtaattcctatgctgaatcccttgatctacagcctgaggaataaggatgtgaagactgctctacagagattcatgacaaatctgtgctattcctttaaaacaatgtaattttaaacagtacaggtaaatgaggagagagttaatataagctgccattatgtaaaagaaaatgtaggaaaaagaaaaggtaggtagccga

SEQ ID NO: 162500 - DNA, 948 bp, Homo sapiens
  Payload ID: 11992
  Gene Symbol: OR8J2
  Gene Name: olfactory receptor, family 8, subfamily J, member 2 (gene/pseudogene)
  ENST ID: ENST00000533152
  CDS Start-End: 1-948
atggcttcaggaaatctcacatgggtgacggagttcattcttgtgggagtctcagatgatccggagctccagattcccctcttcctggtcttcctggtgctctatttgctgaccgtggcagggaacctgggcatcatcaccctcaccagtgttgaccctcaacttcaaacccccatgtactttttcctctgacacttggctattattaatctttgcaattctactgtcgttgcccctaaaatgctggttaacttcctggttaccaagaaaaccatatcatactatggatgtgcagcccaactgggtggattcttggttttcattgtggctgagattttcacgctggctgcaatggcctatgaccgctatgtggctatttggagccctctgctctacgccgtagtggtgtctccaaaggtgtgtcgtctgctggtgtccctcacataccttcagagtcttatcacagcactgactgtctcttcctgtgtgttctctgtgtcatactgttcttccaacattatcaaccatttttactgtgatgatgtccctttgctagcattgtcctgttctgatacctacattccagaaacagcagtctttatcttttcagggaccaacttgcttttctccatgatcgttgttctgatatcctacttcaacattgttattaccattttgaggatacgttcctcagaaggacgacaaaaagccttttccacctgtgcttctcacatgatagctgtggttgtgttctatgggactctccttttcatgtatttgcaaccaaggagtaatcattcattagatactgacaaaatggcttcggtcttctacaccctggtgataccagtgctgaaccctctaatctacagcctcaggaacaagaacgtgaaggatgcactaaagaggttcctagataacccatgccgatcactcaaactaatgtaa

SEQ ID NO: 162501 - DNA, 948 bp, Homo sapiens; identical to SEQ ID NO: 162500
  Payload ID: 11992
  Gene Symbol: OR8J2
  Gene Name: olfactory receptor, family 8, subfamily J, member 2 (gene/pseudogene)
  ENST ID: ENST00000570683
  CDS Start-End: 1-948

SEQ ID NO: 162502 - DNA, 948 bp, Homo sapiens
  Payload ID: 11993
  Gene Symbol: OR8J3
  Gene Name: olfactory receptor, family 8, subfamily J, member 3
  Uniprot ID: Q8NGG0
  ENST ID: ENST00000301529
  CDS Start-End: 1-948
atggctcctgaaaatttcaccagggtcactgagtttattctcacaggtgtctctagctgtccagagctccagattcccctcttcctggtcttcctagtgctctatgtgctgaccatggcagggaacctgggcatcatcaccctcaccagtgttgactctcgacttcaaaaccccatgtactttttcctgagacatctagctatcatcaatcttggcaactctactgtcattgcccctaaaatgctgatgaactttttagtaaagaagaaaactacctcattctatgaatgtgccacccaactgggagggttcttgttctttattgtatcggaggtaatgatgctggctgtgatggcctatgaccgctatgtggccatttgtaaccctctgctctacatggtggtggtgtctcggcggctctgcctcctgctggtgtccctcacatacctctatggcttttctacagctattgtggtttcaccttgtatattctctgtgtcttattgctcttctaatataatcaatcatttttactgtgatattgcacctctgttagcattatcttgctctgatacttacataccagaaacaatagtctttatatctgcagcaacaaatttggttttttccatgattacagttctagtatcttatttcaatattgttttgtccattctaaggatacgttcaccagaaggaaggaaaaaagccttttccacctgcgcttcgcatatgatagcagtcacggttttctatgggacaatgctatttatgtatttgcagccccaaaccaaccactcactggatactgataagatggcttctgtgttttacacattggtgattcctatgctgaatcccttgatctacagcctgaggaataatgatgtaaatgttgccttaaagaaattcatggaaaatccatgttactcctttaaatcaatgtaa

SEQ ID NO: 162503 - DNA, 960 bp, Homo sapiens
  Payload ID: 11994
  Gene Symbol: OR8K1
  Gene Name: olfactory receptor, family 8, subfamily K, member 1
  Uniprot ID: Q8NGG5
  ENST ID: ENST00000279783
  CDS Start-End: 1-960
atgaatcatgtggtaaaacacaatcacacggcagtgaccaaggtgactgaatttattctcatggggattacagacaaccctgggctgcaggctccactgtttggactcttcctcatcatatatctggtcacagtgataggcaatctgggcatggttatcttgacctacttggactccaagctacacacccccatgtactttttccttagacatttgtcaatcactgatcttggttactccactgtcattgccccgaagatgttagtaaacttcatagtgcacaaaaacacaatttcttacaattggtatgccactcagctagcattctttgagattttcatcatctctgagctctttattctatcagcaatggcctatgatcgctacgtagccatctgtaaacctcttctgtacgtgatcatcatggcagagaaagtactttgggtgctggtaattgttccctatctctatagcacgtttgtgtcactatttctcacaattaagttatttaaactgtccttctgtggctcaaacataatcagctatttttactgtgactgtatccctctgatgtccatactctgttctgacacaaatgaattagaattaataattttgatcttctcaggctgtaatttgctcttctccctctcaattgttctcatatcctacatgtttattctagtggccattctcagaatgaactcaaggaaagggaggtacaaagccttctccacctgtagctctcatctgacagtggtgatcatgttctatgggacattgttatttatttacttgcaacccaagtccagtcatactttggctattgataaaatggcctcagtgttttataccctgttgattcctatgctgaatccgttgatctacagcctaaggaacaaagaagtaaaagatgctctaaagagaactttaaccaatcgattcaaaattcccatttaa

SEQ ID NO: 162504 - DNA, 960 bp, Homo sapiens; identical to SEQ ID NO: 162503
  Payload ID: 11994
  Gene Symbol: OR8K1
  Gene Name: olfactory receptor, family 8, subfamily K, member 1
  Uniprot ID: Q8NGG5
  ENST ID: ENST00000574800
  CDS Start-End: 1-960

SEQ ID NO: 162505 - DNA, 939 bp, Homo sapiens
  Payload ID: 11995
  Gene Symbol: OR8K3
  Gene Name: olfactory receptor, family 8, subfamily K, member 3 (gene/pseudogene)
  Uniprot ID: Q8NH51
  ENST ID: ENST00000312711
  CDS Start-End: 1-939
atggaacaacacaatctaacaacggtgaatgaattcattcttacgggaatcacagatatcgctgagctgcaggcaccattatttgcattgttcctcatgatctatgtgatctcagtgatgggcaatttgggcatgattgtcctcaccaagttggactccaggttgcaaacccctatgtacttttttctcagacatctggctttcatggatcttggttattcaacaactgtgggacccaaaatgttagtaaattttgttgtggataagaatataatttcttattatttttgtgcaacacagctagctttctttcttgtgttcattggtagtgaactttttattctctcagccatgtcctacgacctctatgtggccatctgtaaccctctgctatacacagtaatcatgtcacgaagggtatgtcaggtgctggtagcaatcccttacctctattgcacattcatttctcttctagtcaccataaagatttttactttatccttctgtggctacaacgtcattagtcatttctactgtgacagtctccctttgttacctttgctttgttcaaatacacatgaaattgaattgataattctgatctttgcagctattgatttgatttcatctcttctgatagttcttttatcttacctgctcatccttgtagccattctcaggatgaattctgctggcagacaaaaggctttttctacctgtggagcccacctgacagtggtcatagtgttctatgggactttgcttttcatgtacgtgcagcccaagtccagtcattcctttgacactgataaagtggcttccatattttacaccctggttatccccatgttgaatcccttgatctatagtttacgaaacaaagatgtaaaatatgccctacgaaggacatggaataacttatgtaatatttttgtttaa

SEQ ID NO: 162506 - DNA, 939 bp, Homo sapiens; identical to SEQ ID NO: 162505
  Payload ID: 11995
  Gene Symbol: OR8K3
  Gene Name: olfactory receptor, family 8, subfamily K, member 3 (gene/pseudogene)
  Uniprot ID: Q8NH51
  ENST ID: ENST00000573400
  CDS Start-End: 1-939

SEQ ID NO: 162507 - DNA, 939 bp, Homo sapiens; identical to SEQ ID NO: 162505
  Payload ID: 11995
  Gene Symbol: OR8K3
  Gene Name: olfactory receptor, family 8, subfamily K, member 3 (gene/pseudogene)
  Uniprot ID: Q8NH51
  ENST ID: ENST00000623750
  CDS Start-End: 1-939

SEQ ID NO: 162508 - DNA, 939 bp, Homo sapiens; identical to SEQ ID NO: 162505
  Payload ID: 11995
  Gene Symbol: OR8K3
  Gene Name: olfactory receptor, family 8, subfamily K, member 3 (gene/pseudogene)
  Uniprot ID: Q8NH51
  ENST ID: ENST00000623845
  CDS Start-End: 1-939

SEQ ID NO: 162509 - DNA, 924 bp, Homo sapiens
  Payload ID: 11996
  Gene Symbol: OR8K5
  Gene Name: olfactory receptor, family 8, subfamily K, member 5
  Uniprot ID: Q8NH50
  ENST ID: ENST00000313447
  CDS Start-End: 1-924
atgggccaacacaatctaacagtgctaactgaattcattctgatggaactcacaaggcggcctgagctgcagattcccctttttggagtcttcctcgtcatctacctaatcacagtggtgggcaacctaactatgatcattttgaccaaactggactcccacttacatacacctatgtacttttctatcagacatttggcttttgttgatcttggtaattctactgtcatttgtcccaaggtgctggcaaattttgttgtggatcgaaatactatttcctattatgcatgtgctgcacagctggcattcttccttatgttcattatcagtgaatttttcatcctgtcagccatggcctatgaccgctatgtggccatttgtaaccctctgctctattatgttattatgtctcagcgactgtgtcatgtactggtgggcattcaatatctctacagcacatttcaggctctgatgttcactattaagatttttacattgaccttctgtggctctaatgtcatcagtcatttttactgtgatgatgttcctttgctacctatgctttgctcaaatgcacaggaaatagaattgttgagcatactattttctgtatttaatttgatctcctcctttctgatagtcttagtgtcctacatgttgattttgttagctatatgtcaaatgcattctgcagagggcaggaaaaaggctttctccacatgtggttcccatttgacagtggtggttgtgttctatgggtctctactcttcatgtacatgcagcccaattccactcacttctttgatactgataaaatggcttctgtgttttacactttagtaatccccatgcttaaccctttgatttacagcttaagaaacgaagaggtgaaaaatgccttctataagctctttgagaattga

SEQ ID NO: 162510 - DNA, 1080 bp, Homo sapiens
  Payload ID: 11997
  Gene Symbol: OR8S1
  Gene Name: olfactory receptor, family 8, subfamily S, member 1
  Uniprot ID: Q8NH09
  ENST ID: ENST00000310194
  CDS Start-End: 1-1080
atggccttggggaatcacagcaccatcaccgagttcctcctccttgggctgtctgccgaccccaacatccgggctctgctctttgtgctgttcctggggatttacctcctgaccataatggaaaacctgatgctgctgctcatgatcagggctgattcttgtctccataagcccatgtatttcttcctgagtcacctctcttttgttgatctctgcttctcttcagtcattgtgcccaagatgctggagaacctcctgtcacagaggaaaaccatttcagtagagggctgcctggctcaggtcttctttgtgtttgtcactgcagggactgaagcctgccttctctcagggatggcctatgaccgccatgctgccatctgccgcccactactttatggacagatcatgggtaaacagctgtatatgcaccttgtgtggggctcatggggactgggctttctggacgcactcatcaatgtcctcctagctgtaaacatggtcttttgtgaagccaaaatcattcaccactacagctatgagatgccatccctcctccctctgtcctgctctgatatctccagaagcctcatcgccttgctctgctccactctcctacatgggctgggaaacttccttttggtcttcttatcctacacccgtataatctctaccatcctaagcatcagctctacctcgggcagaagcaaggccttctccacctgctctgcccacctcactgcagtgacactttactatggctcaggtttgctccgccatctcatgccaaactcaggttcccccatagagttgatcttctctgtgcagtatactgtagtcactcccatgctgaattccctcatctatagcctgaaaaataaggaagtgaagggggaaagaagcctccgggacagcagtcatttgcctcagctgcacaaaggccaggccagatggaagagaccagccttcaccgaaggccgcagggagcccggacacccggagctgagcattccggtcacgcctcaaccccaaggggcctgcgcatgctccgcgctgcgcgcggcgcccacggccctgccctga

SEQ ID NO: 162511 - DNA, 930 bp, Homo sapiens
  Payload ID: 11998
  Gene Symbol: OR8U1
  Gene Name: olfactory receptor, family 8, subfamily U, member 1
  Uniprot ID: Q8NH10
  ENST ID: ENST00000302270
  CDS Start-End: 1-930
atggctcacatcaattgcacccaggcgacagagtttattcttgtgggcctcacagaccatcaggagttgaagatgcccctctttgtgctattcttatccatctacctcttcacagtggtaggcaacttgggtttgatcctactcattagagcggatacaagtctcaacacaccaatgtacttctttcttagcaacctagcttttgtggatttctgttactcttctgtcattacacccaaaatgcttgggaatttcttgtacaaacaaaatgttatatcctttgatgcatgtgctactcaactgggctgctttctcaccttcatgatatcagaatccttgctactggcttccatggcctatgaccgatatgtggccatttgtaaccctctattgtatatggttgtaatgactccaggaatctgcattcaacttgtagcagttccttatagctatagcttcctaatggcactatttcacaccatcctcaccttccgcctctcctattgccactccaacattgtcaaccatttctattgtgatgacatgcctctcctcaggctaacttgctcagacactcgcttcaaacagctctggatctttgcctgtgctggtatcatgttcatttcctcccttctgattgtctttgtctcctacatgttcatcatttctgccatcctgaggatgcattcagctgagggaagacagaaggctttctcgacgtgtggctctcacatgctggcagtcaccatattctatgggaccctcatttttatgtacttacagcctagctctagccatgccctggacacagacaagatggcctctgtcttctacacagtgatcattcccatgttgaatcccttaatctatagcctccagaataaggaggtgaaagaagctctgaagaaaatcattatcaataaaaactag

SEQ ID NO: 162512 - DNA, 930 bp, Homo sapiens
  Payload ID: 11998
  Gene Symbol: OR8U1
  Gene Name: olfactory receptor, family 8, subfamily U, member 1
  Uniprot ID: P0C7N5
  ENST ID: ENST00000626074
  CDS Start-End: 1-930
atgactcagatcaattgcacccaggtgacagagtttattcttgtgggcctcacagatcgtcaggagttgaagatgcccctctttgtgctattcttatctatctatcttttcacagtagtaggcaatctgggtttgatcctactcattagaacagatgaaaaactcaacacaccaatgtacttctttcttagcaacctagcttttgtggatttctgttactcttctgtcattacacccaaaatgcttgggaatttcttatataaacaaaatagtatttcgttcaatgcatgtgctgctcagttaggctgtttcctggccttcatgacggctgagtgcttgctactggcttccatggcctatgaccgatatgtggccatttgtaaccctctgatgtatatggtggtaatgtccccaggaatctgcattcagcttgtggctgctccccatagctatagcatcttggttgcactgtttcacaccatcctcaccttccgcctctcctattgccactccaacattgtcaaccatttctattgtgatgacatgcctctcctcaggctaacttgctcagacactcgcttcaaacagctctggatctttgcctgtgctggtatcatgttcatttcctcccttctgattgtctttgtctcctacatgttcatcatttctgccatcctgaggatgcattcagctgagggaagacagaaggctttctcgacgtgtggctctcacatgctggcagtcaccatattctatgggaccctcatttttatgtacttacagcctagctctagccatgccctggacacagacaagatggcctctgtcttctacacagtgatcattcccatgttgaatcccttaatctatagcctccagaataaggaggtgaaagaagctctgaagaaaatcattatcaataaaaactag

SEQ ID NO: 162513 - DNA, 930 bp, Homo sapiens
  Payload ID: 11999
  Gene Symbol: OR8U8
  Gene Name: olfactory receptor, family 8, subfamily U, member 8
  ENST ID: ENST00000570574
  CDS Start-End: 1-930
atggctcacatcaattgcacccaggcgacagagtttattcttgtgggcctcacagatcgtcaggagttgaagatgcccctctttgtgctattcttatccatctacctcttcacagtggtaggcaacttgggtttgatcctactcattagagcggatacaagtctcaacacaccaatgtacttctttcttagcaacctagcttttgtggatttctgttactcttctgtcattacacccaaaatgcttgggaatttcttgtacaaacaaaatgttatatcctttgatgcatgtgctactcaactgggctgctttctcaccttcatgatatcagaatccttgctactggcttccatggcctatgaccgatatgtggccatttgtaaccctctattgtatatggttgtaatgactccaggaatctgcattcaacttgtagcagttccttatagctatagcttcctaatggcactatttcacaccatcctcaccttccgcctctcctattgccactccaacattgtcaaccatttctattgtgatgacatgcctctcctcaggctaacttgctcagacactcgcttcaaacagctctggatctttgcctgtgctggtatcatgttcatttcctcccttctgattgtctttgtctcctacatgttcatcatttctgccatcctgaggatgcattcagctgagggaagacagaaggctttctcgacgtgtggctctcacatgctggcagtcaccatattctatgggaccctcatttttatgtacttacagcctagctctagccatgccctggacacagacaagatggcctctgtcttctacacagtgatcattcccatgttgaatcccttaatctatagcctccagaataaggaggtgaaagaagctctgaagaaaatcattatcaataaaaactag

SEQ ID NO: 162514 - DNA, 960 bp, Homo sapiens
  Payload ID: 11999
  Gene Symbol: OR8U8
  Gene Name: olfactory receptor, family 8, subfamily U, member 8
  ENST ID: ENST00000627176
  CDS Start-End: 1-960
atggctcacatcaattgcacccaggcgacagagtttattcttgtgggcctcacagatcgtcaggagttgaagatgcccctctttgtgctattcttatccatctacctcttcacagtggtaggcaacttgggtttgatcctactcattagagcggatacaagtctcaacacaccaatgtacttctttcttagcaacctagcttttgtggatttctgttactcttctgtcattacacccaaaatgcttgggaatttcttgtacaaacaaaatgttatatcctttgatgcatgtgctactcaactgggctgctttctcaccttcatgatatcagaatccttgctactggcttccatggcctatgaccgatatgtggccatttgtaaccctctattgtatatggttgtaatgactccaggaatctgcattcaacttgtagcagttccttatagctatagcttcctaatggcactatttcacaccatcctcaccttctgcctctcctattgccactccaacattgtcaaccatttctattgtgatgacatgcctctcctcaggctaacttgctcagacactcgcttcaaacagctatggattttggcctgtgctggtatcacattcatctgctctgttctgattgtctttgtctcctacatgttcattatttttgccatcctgaggatgagctcagctgaaggaagacgcaaagccttctccacctgtagctctcacatgctggcagtcaccatattctatggcaccctgatctttatgtacttacaaccaagctcaagccattctcttgatgcagacaagatggcctctgtcttctacacggtgattattcccatgttgaatcccttgatttacagtctcaggaacaaagatgtaaaagatgccctgaagaaagtcatcatcaatagaaaccatgcttttatttttctgaaactgagaaaatga

SEQ ID NO: 162515 - DNA, 1038 bp, Homo sapiens
  Payload ID: 12000
  Gene Symbol: OR9A2
  Gene Name: olfactory receptor, family 9, subfamily A, member 2
  Uniprot ID: Q8NGT5
  ENST ID: ENST00000350513
  CDS Start-End: 64-996
tgtggagcaatgccacctctcttttaatctctgggcttcaaaacaagcagaatcaaggactaaatgatggacaaccactctagtgccactgaattccaccttctaggcttccctgggtcccaaggactacaccacattctttttgctatattctttttcttctatttagtgacattaatgggaaacacggtcatcattgtgattgtctgtgtggataaacgtctgcagtcccccatgtatttcttcctcagccacctctctaccctggagatcctggtcacaaccataattgtccccatgatgctttggggattgctcttcctgggatgcagacagtatctttctctacatgtatcgctcaacttttcctgtgggaccatggagtttgcattacttggagtgatggctgtggaccgttatgtggctgtgtgtaaccctttgaggtacaacatcattatgaacagcagtacctgtatttgggtggtaatagtgtcatgggtgtttggatttctttctgaaatctggcccatctatgccacatttcagtttaccttccgcaaatcaaattcattagaccatttttactgtgaccgagggcaattgctcaaactgtcctgcgataacactcttctcacagagtttatccttttcttaatggctgtttttattctcattggttctttgatccctacgattgtctcctacacctacattatctccaccatcctcaagatcccgtcagcctctggccggaggaaagccttctccacttttgcctcccacttcacctgtgttgtgattggctatggcagctgcttgtttctctacgtgaaacccaagcaaacacagggagttgagtacaataagatagtttccctgttggtttctgtgttaacccccttcctgaatcctttcatctttactcttcggaatgacaaagtcaaagaggccctccgagatgggatgaaacgctgctgtcaactcctgaaagattagctgttctgtaagtcagttttaggtggtccaagcctcagggtt

SEQ ID NO: 162516 - DNA, 1038 bp, Homo sapiens; identical to SEQ ID NO: 162515
  Payload ID: 12000
  Gene Symbol: OR9A2
  Gene Name: olfactory receptor, family 9, subfamily A, member 2
  Uniprot ID: Q8NGT5
  ENST ID: ENST00000619330
  CDS Start-End: 64-996

SEQ ID NO: 162517 - DNA, 1093 bp, Homo sapiens
  Payload ID: 12001
  Gene Symbol: OR9A4
  Gene Name: olfactory receptor, family 9, subfamily A, member 4
  Uniprot ID: Q8NGU2
  ENST ID: ENST00000548136
  CDS Start-End: 60-1004
gcggttgttctctctcttttgctctctagatttcacaaggaacaagggcttagaactaaatgttgatgaattactctagtgccactgaattttatctccttggcttccctggctctgaagaactacatcatatcctttttgctatattcttctttttctacttggtgacattaatgggaaacacagtcatcatcatgattgtctgtgtggataaacgtctgcagtcccccatgtatttcttcctcggccacctctctgccctggagatcctggtcacaaccataatcgtccccgtgatgctttggggattgctgctccctgggatgcagacaatatatttgtctgcctgtgttgtccagctcttcttgtaccttgctgtggggacaacagagttcgcattacttggagcaatggctgtggaccgttatgtggctgtctgtaaccctctgaggtacaacatcattatgaacagacacacctgcaactttgtggttcttgtgtcatgggtgtttgggtttctttttcaaatctggccggtctatgtcatgtttcagcttacttactgcaaatcaaatgtggtgaacaattttttttgtgaccgagggcaattgctcaaactatcctgcaataatactcttttcacggagtttatcctcttcttaatggctgtttttgttctctttggttctttgatccctacaattgtctccaacgcctacatcatctccaccattctcaagatcccgtcatcctctggccggaggaaatccttctccacttgtgcctcccacttcacctgtgttgtgattggctacggcagctgcttgtttctctacgtgaaacccaagcaaacgcaggcagctgattacaattgggtagtttccctgatggtttcagtagtaactcctttcctcaatcctttcatcttcaccctccggaatgataaagtcatagaggcccttcgggatggggtgaaacgctgctgtcaactattcaggaattagccttgctctgaggacttttacatggtaaagcacttagtatggattctagaataatctgaaaagaacttgctcatctttgaactgcatca

SEQ ID NO: 162518 - DNA, 918 bp, Homo sapiens
  Payload ID: 12002
  Gene Symbol: OR9G1
  Gene Name: olfactory receptor, family 9, subfamily G, member 1
  Uniprot ID: Q8NH87
  ENST ID: ENST00000312153
  CDS Start-End: 1-918
atgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttttcactggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataa

SEQ ID NO: 162519 - DNA, 918 bp, Homo sapiens
  Payload ID: 12002
  Gene Symbol: OR9G1
  Gene Name: olfactory receptor, family 9, subfamily G, member 1
  ENST ID: ENST00000573911
  CDS Start-End: 1-918
atgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcccgcctccacacacccatgtattttttcattggaaatctgtcgtttctggatctctggtattcttctgtctacaccccaaagatcctagtgacctgcatctctgaagacaaaagcatctcctttgctggctgcctgggtcagttcttcttctctgcagggctggcctatagtgagtgctacctgctggctgccgtggcttatgaccgctacgtggccatctccaagcccctgctttatgctcaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcggtgctcatcctggcctcctacctctttatcatcaccagtgtcttgaggatctcctcctcccagggccgcctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataa

SEQ ID NO: 162520 - DNA, 985 bp, Homo sapiens
  Payload ID: 12003
  Gene Symbol: OR9G4
  Gene Name: olfactory receptor, family 9, subfamily G, member 4
  Uniprot ID: Q8NGQ1
  ENST ID: ENST00000302957
  CDS Start-End: 1-984
atgattttcccttctcatgatagtcaggctttcacctccgtggacatggaagtgggaaattgcaccatcctgactgaattcatcttgttgggtttctcagcagattcccagtggcagccgattctatttggagtgtttctgatgctctatttgataaccttgtcaggaaacatgaccttggttatcttaatccgaactgattcccacttgcatacacctatgtactttttcattggcaatctgtcttttttggatttctggtatacctctgtgtatacccccaaaatcctggccagttgtgtctcagaagataagcgcatttccttggctggatgtggggctcagctgtttttttcctgtgttgtagcctacactgaatgctatctcctggcagccatggcatatgaccgccatgcagcaatttgtaacccattgctttattcaggtaccatgtccaccgccctctgtactgggcttgttgctggctcctacataggaggatttttgaatgccatagcccatactgccaatacattccgcctgcatttttgtggtaaaaatatcattgaccactttttctgtgatgcaccaccattggtaaaaatgtcctgtacaaacaccagggtctacgaaaaagtcctgcttggtgtggtgggcttcacagtactctccagcattcttgctatcctgatttcctatgtcaacatcctcctggctatcctgagaatccactcagcttcaggaagacacaaggcattctccacctgtgcttcccacctcatctcagtcatgctcttctatggatcattgttgtttatgtattcaaggcctagttccacctactccctagagagggacaaagtagctgctctgttctacaccgtgatcaacccactgctcaaccctctcatctatagcctgagaaacaaagatatcaaagaggccttcaggaaagcaacacagactatacaaccacaaacatgaa

SEQ ID NO: 162521 - DNA, 985 bp, Homo sapiens; identical to SEQ ID NO: 162520
  Payload ID: 12003
  Gene Symbol: OR9G4
  Gene Name: olfactory receptor, family 9, subfamily G, member 4
  Uniprot ID: Q8NGQ1
  ENST ID: ENST00000575017
  CDS Start-End: 1-984

SEQ ID NO: 162522 - DNA, 918 bp, Homo sapiens
  Payload ID: 12004
  Gene Symbol: OR9G9
  Gene Name: olfactory receptor, family 9, subfamily G, member 9
  ENST ID: ENST00000571130
  CDS Start-End: 1-918
atgcagaggagcaatcacacagtgactgagtttatactgctgggcttcaccacagacccagggatgcagctgggcctcttcgtggtgttcctgggcgtgtactctctcactgtggtaggaaatagcaccctcatcgtgttgatctgtaatgactcccacctccacacacccatgtattttgtcgttggaaatctgtcgtttctggatctctggtattcttctgtctacaccccaaagatcctagtgatctgcatctctgaagacaaaagcatctcctttgctggctgcctgtgtcagttcttcttctctgcagggctggcctatagtgagtgctgcttactggctgccatggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgctgtgaaaacatcattgatgactttttctgtgatttacttcccttggtgaagctggcctgtggcgagaagggcggctataagtttctgatgtacttcctgctggcctccaatgtcatctgccccgcggtgctcatcctggcctcctacctctttatcatcaccagtgtcttgaggatctcctcctcccagggccgcctcaaagccttctccacatgctcctcccacctgacctctgtcactttatactatggctccattctctacatctatgctctccctagatctagctattcttttgatatggacaaaatagtttctacattttatactgaggtactccccatgttgaatcccatgatctacagcctaaggaataaggatgtgaaagaggctctgaaaaaacttctcccataa

SEQ ID NO: 162523 - DNA, 945 bp, Homo sapiens
  Payload ID: 12005
  Gene Symbol: OR9I1
  Gene Name: olfactory receptor, family 9, subfamily I, member 1
  Uniprot ID: Q8NGQ6
  ENST ID: ENST00000302610
  CDS Start-End: 1-945
atggccaagaataatctcaccagagtaaccgaattcattctcatgggctttatggaccaccccaaattggagattcccctctttctggtgtttctgagtttctacctagtcacccttcttgggaatgtggggatgattatgttaatccaagtagatgtcaaactctacaccccaatgtacttcttcctgagccacctctccctgctggatgcctgttacacctcagtcatcacccctcagatcctagccacattggccacaggcaaaacggtcatctcctacggccactgtgctgcccagttctttttattcaccatctgtgcaggcacagagtgctttctgctggcagtgatggcctatgatcgctatgctgccattcgcaacccactgctctataccgtggccatgaatcccaggctctgctggagcctggtggtaggagcctatgtctgtggggtgtcaggagccatcctgcgtaccacttgcaccttcaccctctccttctgtaaggacaatcaaataaacttcttcttctgtgacctcccacccctgctgaagcttgcctgcagtgacacagcaaacatcgagattgtcatcatcttctttggcaattttgtgattttggccaatgcctccgtcatcctgatttcctatctgctcatcatcaagaccattttgaaagtgaagtcttcaggtggcagggccaagactttctccacatgtgcctctcacatcactgctgtggcccttttctttggagcccttatcttcatgtatctgcaaagtggctcaggcaaatctctggaggaagacaaagtcgtgtctgtcttctatacagtggtcatccccatgctgaaccctctgatctacagcttaagaaacaaagatgtaaaagacgccttcagaaaggtcgctaggagactccaggtgtccctgagcatgtag

SEQ ID NO: 162524 - DNA, 1122 bp, Homo sapiens
  Payload ID: 12006
  Gene Symbol: OR9K2
  Gene Name: olfactory receptor, family 9, subfamily K, member 2
  Uniprot ID: Q8NGE7
  ENST ID: ENST00000305377
  CDS Start-End: 89-1096
tcacagtatacttatgaggcaaaaattaataataacattaatttaaaaatagctttgtaaatcctaataccataagagattatttgtaatgctaggatccaaaccaagagttcatttgtatattttgccctgtgcctctcaacaggtttctaccatgggtgacaggggaacaagcaatcactcagaaatgactgacttcattcttgcaggcttcagggtacgcccagagctccacattctcctcttcctgctatttttgtttgtttatgccatgatccttctagggaatgttgggatgatgaccattattatgactgatcctcggctgaacacaccaatgtattttttcctaggcaatctctccttcattgatcttttctattcatctgttattgaacccaaggctatgatcaacttctggtctgaaaacaagtctatctcctttgcaggctgtgtggcccagctctttctctttgccctcctcattgtgactgagggatttctcctggcggccatggcttatgaccgctttattgccatctgcaaccctctgctctactctgttcaaatgtccacacgtctgtgtactcagttggtggctggttcctatttttgtggctgcattagctcagttattcagactagcatgacatttactttatctttttgcgcttctcgggctgttgaccacttttactgtgattctcgcccacttcagagactgtcttgttctgatctctttatccatagaatgatatctttttccttatcatgtattattatcttgcctactatcatagtcattatagtatcttacatgtatattgtgtccacagttctaaagatacattctactgagggacataagaaggccttctccacctgcagctctcacctgggagttgtgagtgtgctgtatggtgctgtcttttttatgtatctcactcctgacagatttcctgagctgagtaaagtggcatccttatgttactccctagtcactcccatgttgaatcctttgatttactctctgaggaacaaagatgtccaagaggctctaaaaaaatttctagagaagaaaaatattattctttgattattatttctctttcaccaatttta

SEQ ID NO: 162525 - DNA, 2488 bp, Homo sapiens
  Payload ID: 12007
  Gene Symbol: OR9Q1
  Gene Name: olfactory receptor, family 9, subfamily Q, member 1
  Uniprot ID: Q8NGQ5
  ENST ID: ENST00000335397
  CDS Start-End: 317-1249
ggtggcccttgtgcagggaattgaagaagtgcaggaggatgccacacagagatggtagagggagcgaaaggagcaaaggccctaactttcccttaatgatgtctccttccatctttagtccagcccagcaatgtacatgttatccttcccgtttgaagatgaagacactgaggctcagaaagatcaaacgcctttcccaaactcacagctacggcctgacggagccatgtaagcaccaagaagacccttaccagacactgcatgctggtgccttgatcttggacttcccagcctcctgaactggaccactggtgtcatggcagagatgaacctcaccttggtgaccgagttcctccttattgcattcactgaatatcctgaatgggcactccctctcttcctcttgtttttatttatgtatctcatcaccgtattggggaacttagagatgattattctgatcctcatggatcaccagctccacgctccaatgtatttccttctgagtcacctcgctttcatggacgtctgctactcatctatcactgtcccccagatgctggcagtgctgctggagcatggggcagctttatcttacacacgctgtgctgctcagttctttctgttcaccttctttggttccatcgactgctacctcttggccctcatggcctatgaccgctacttggctgtgtgccagcccctgctttatgtcaccatcctgacacagcaggcccgcttgagtcttgtggctggggcttacgttgctggtctcatcagtgccttggtgcggacagtctcagccttcactctctccttctgtggaaccagtgagattgactttattttctgtgacctccctcctctgttaaagttgacctgtggggagagctacactcaagaagtgctgattattatgtttgccatttttgtcatccctgcttccatggtggtgatcttggtgtcctacctgtttatcatcgtggccatcatggggatccctgctggaagccaggccaagaccttctccacctgcacctcccacctcactgctgtgtcactcttctttggtaccctcatcttcatgtacttgagaggtaactcagatcagtcttcggagaagaatcgggtagtgtctgtgctttacacagaggtcatccccatgttgaatcccctcatctacagcctgaggaacaaggaagtgaaggaggccctgagaaaaattctcaatagagccaagttgtcctaaccatctccaaacttggaaaatcccgagaaccacctactctgtagtgtcagaattctggacgctcattatttatagcatgctcaatgtttaaatgaatatattatggtactaggtataaaaaagaaccagaacttttagctccagggagaggaaggaagacaaggaaaagtcaacctgaaaagagattggagtgggagttttgattcccaggacaagtgacaaaaggatttgaaattaaagcctgtgcaatccaaatatggcacacttcacctgtctgtgattataagagtaattttttttgcaaaatttttaatgaaagattttcatcatatagaaatgttaaaaataatatgtaggaagtttcctatactcagtactgagattgtgtaattgctaatatttgctgtctttacttggttacatagatgtaatctatccgtgagtttattcatcaatcaattcactcatcaaaccacctttttttgattcatttcaaggtgagttccggacatcagcattagtaccctttacttctatgcacttcagaattatatcatcaattaggattcaatatttagattacatttatttttaatgatcaaactatggtcgtttgatgatccaattagcaaagctgaccctactcaaggtatgccttaatattctggtagtagttctcaagaaggcctcacacaaacttttaacaatgcctacaataacatgtctgtcaattgctatcacctctggatatatgccctgttctttttcttcctacctattacagttctctctcgtcatatggcatgactaaaaatccacttagcaaagttataccattcccactgcccataatggcgtcttcagtgtctgtatcatagacattgactctctgtgttctgaaagctttttccttcagggaggcagaacattgctgcattccacatggcgataggcaggagggtggtcctcgcctatcctgggtccctgcactctgcagcagctcagcctgcatccaaagcctcacaaaatctgtctgttcttaatctttacttctctaatcacaggggacttgtctcaatcaaacccaaggcactggaagagagcaggccccatctattaattttttttcatttaaacaaatttttatacctggaactcaaacttcttttcctgtctcctggattactaaaaaaaaaaaaaaaaaaaaaaatccaaaaccaaaacaacaacaacaaaaaa

SEQ ID NO: 162526 - DNA, 2134 bp, Homo sapiens
  Payload ID: 12007
  Gene Symbol: OR9Q1
  Gene Name: olfactory receptor, family 9, subfamily Q, member 1
  Uniprot ID: Q8NGQ5
  ENST ID: ENST00000612174
  CDS Start-End: 15-947
ggaccactggtgtcatggcagagatgaacctcaccttggtgaccgagttcctccttattgcattcactgaatatcctgaatgggcactccctctcttcctcttgtttttatttatgtatctcatcaccgtattggggaacttagagatgattattctgatcctcatggatcaccagctccacgctccaatgtatttccttctgagtcacctcgctttcatggacgtctgctactcatctatcactgtcccccagatgctggcagtgctgctggagcatggggcagctttatcttacacacgctgtgctgctcagttctttctgttcaccttctttggttccatcgactgctacctcttggccctcatggcctatgaccgctacttggctgtgtgccagcccctgctttatgtcaccatcctgacacagcaggcccgcttgagtcttgtggctggggcttacgttgctggtctcatcagtgccttggtgcggacagtctcagccttcactctctccttctgtggaaccagtgagattgactttattttctgtgacctccctcctctgttaaagttgacctgtggggagagctacactcaagaagtgctgattattatgtttgccatttttgtcatccctgcttccatggtggtgatcttggtgtcctacctgtttatcatcgtggccatcatggggatccctgctggaagccaggccaagaccttctccacctgcacctcccacctcactgctgtgtcactcttctttggtaccctcatcttcatgtacttgagaggtaactcagatcagtcttcggagaagaatcgggtagtgtctgtgctttacacagaggtcatccccatgttgaatcccctcatctacagcctgaggaacaaggaagtgaaggaggccctgagaaaaattctcaatagagccaagttgtcctaaccatctccaaacttggaaaatcccgagaaccacctactctgtagtgtcagaattctggacgctcattatttatagcatgctcaatgtttaaatgaatatattatggtactaggtataaaaaagaaccagaacttttagctccagggagaggaaggaagacaaggaaaagtcaacctgaaaagagattggagtgggagttttgattcccaggacaagtgacaaaaggatttgaaattaaagcctgtgcaatccaaatatggcacacttcacctgtctgtgattataagagtaattttttttgcaaaatttttaatgaaagattttcatcatatagaaatgttaaaaataatatgtaggaagtttcctatactcagtactgagattgtgtaattgctaatatttgctgtctttacttggttacatagatgtaatctatccgtgagtttattcatcaatcaattcactcatcaaaccacctttttttgattcatttcaaggtgagttccggacatcagcattagtaccctttacttctatgcacttcagaattatatcatcaattaggattcaatatttagattacatttatttttaatgatcaaactatggtcgtttgatgatccaattagcaaagctgaccctactcaaggtatgccttaatattctggtagtagttctcaagaaggcctcacacaaacttttaacaatgcctacaataacatgtctgtcaattgctatcacctctggatatatgccctgttctttttcttcctacctattacagttctctctcgtcatatggcatgactaaaaatccacttagcaaagttataccattcccactgcccataatggcgtcttcagtgtctgtatcatagacattgactctctgtgttctgaaagctttttccttcagggaggcagaacattgctgcattccacatggcgataggcaggagggtggtcctcgcctatcctgggtccctgcactctgcagcagctcagcctgcatccaaagcctcacaaaatctgtctgttcttaatctttacttctctaatcacaggggacttgtctcaatcaaacccaaggcactggaagagagcaggccccatctattaattttttttcatttaaacaaatttttatacctggaactcaaacttcttttcctgtctcctggattact

SEQ ID NO: 162527 - DNA, 1085 bp, Homo sapiens
  Payload ID: 12008
  Gene Symbol: OR9Q2
  Gene Name: olfactory receptor, family 9, subfamily Q, member 2
  Uniprot ID: Q8NGE9
  ENST ID: ENST00000311591
  CDS Start-End: 58-1002
tgagctgtcccctcatctggctcttgtcttagccgttgcaggtgaaccactggatggatggctgaaaggaattacaccgtagtgacggagttcttccttactgcatttactgaacatctccagtggagggttcctctcttcctcatatttttgagtttctatcttgccactatgttagggaacacaggcatgatcctcctgatccgtggcgatcgtcggctccacaccccgatgtacttcttcctcagccacctttccttggtggacatctgctactcgtccgccatcatccctcagatgctggctgtgctgtgggagcacggcacaaccatctcccaggctcgctgtgcagctcagttcttcctcttcaccttctttgcctccatcgactgctaccttctggccatcatggcctatgaccgctacacggccgtgtgccagcccctgctttatgtcaccatcataaccgagaaggcccgctggggcctagtcactggggcttacgttgctggttttttcagtgcctttgttcgaacggtcacagccttcactctctccttttgtggaaacaatgagatcaacttcattttctgtgacctccctcctctattaaaactctcctgtggggacagctacactcaggaagtggtgattattgtgtttgctcttttcgtcatgcctgcctgtatcttggtgatcttggtatcctacctgtttatcattgtggccatcctgcagatccactctgctggaggccgggccaagaccttctccacctgcgcctcccacctcactgccgtcgctcttttctttggcaccctcatcttcatgtacctgcgagacaacacaggccagtcctccgagggagaccgagtggtgtctgtgctctacacggtggtgaccccaatgctgaatccccttatctatagcctgagaaacaaggaggtaaaagaggccactaggaaagccctgagcaaatcaaagcctgctagaagaccctaaatggacccttgtgaaatatatcattccttagtttccccatcttttctgtcttttctcaatagcaccttctggagagactttcc

SEQ ID NO: 162528 - DNA, 3262 bp, Homo sapiens
  Payload ID: 12009
  Gene Symbol: OLIG2
  Gene Name: oligodendrocyte lineage transcription factor 2
  Uniprot ID: Q13516
  ENST ID: ENST00000333337
  CDS Start-End: 929-1900
ggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaa

SEQ ID NO: 162529 - DNA, 2578 bp, Homo sapiens
  Payload ID: 12009
  Gene Symbol: OLIG2
  Gene Name: oligodendrocyte lineage transcription factor 2
  Uniprot ID: Q13516
  ENST ID: ENST00000382357
  CDS Start-End: 245-1216
gcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaa

SEQ ID NO: 162530 - DNA, 575 bp, Homo sapiens
  Payload ID: 12009
  Gene Symbol: OLIG2
  Gene Name: oligodendrocyte lineage transcription factor 2
  ENST ID: ENST00000430860
  CDS Start-End: 389-575
ggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctgttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgg

SEQ ID NO: 162531 - DNA, 1947 bp, Homo sapiens
  Payload ID: 12010
  Gene Symbol: OMG
  Gene Name: oligodendrocyte myelin glycoprotein
  Uniprot ID: P23515
  ENST ID: ENST00000247271
  CDS Start-End: 263-1585
acaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataa

SEQ ID NO: 162532 - DNA, 2277 bp, Homo sapiens
  Payload ID: 12011
  Gene Symbol: OLIG1
  Gene Name: oligodendrocyte transcription factor 1
  Uniprot ID: Q8TAK6
  ENST ID: ENST00000382348
  CDS Start-End: 104-919
atcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttta

SEQ ID NO: 162533 - DNA, 1083 bp, Homo sapiens
  Payload ID: 12011
  Gene Symbol: OLIG1
  Gene Name: oligodendrocyte transcription factor 1
  ENST ID: ENST00000426947
  CDS Start-End: 1-98
gcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctga

SEQ ID NO: 162534 - DNA, 2049 bp, Homo sapiens
  Payload ID: 12012
  Gene Symbol: OLIG3
  Gene Name: oligodendrocyte transcription factor 3
  Uniprot ID: Q7RTU3
  ENST ID: ENST00000367734
  CDS Start-End: 81-899
ttttttttttttaattcaagattttctttaatttcccgcctaaagcctccccacggtagggccgcatcccctgtaataaaatgaattctgattcgagctctgtctccagcagagcttcatctccggacatggatgagatgtacctgagggaccaccaccaccgccaccaccaccaccaggagagccgtctcaactcggtctcgtccacgcagggcgatatgatgcagaagatgcccggggaaagcctctcgcgggctggcgccaaggccgcgggagagagcagcaagtacaaaatcaagaagcagctgtcggagcaggacctacagcagttgaggctgaagatcaacggacgcgaacgcaagcggatgcacgacctgaacctagccatggacgggctgcgcgaagtcatgccctacgcgcatgggccgtcggtgcgcaagctctccaagatcgccacactcctgctcgccagaaactacatcctcatgctcaccagctccctggaggagatgaagaggctggttggcgagatctatgggggccaccactcggcctttcactgcgggaccgtgggccactcggccggccaccccgcgcacgcggccaactccgtgcacccggtgcaccccatcttgggcggcgcgctctcatctggcaacgcctcgtcaccgctgtccgccgcctcacttcccgccatcggcaccatccggcctccccactcgctactcaaggcgccctccacgccgcccgcgctgcagctgggcagcggcttccagcactgggctggtctgccctgcccctgcaccatctgccagatgccgccgccgccgcacctgtccgctctctccacagccaacatggcccggctgtcggccgagtccaaggacttgctcaagtgagcagcgggcgggcccggctgccaaggaggagggagagcggcgggaggggccgcggtgccgggccgggagggaagagggaggctgcacgctcggcccacgggagggcaggctccggggcccgcagcctcccacgctgtctgagagatctcagactccacttgacccccggagggaaaggaccaaaatcaaaccgcaatttctaggtggtagcaaagggggactcgaaccagatgtcgtgtgttttgcatgcatgcttcttttccccatgccgcgccagtatttttcactgccatatgctcttgtcaaaactgcatttgttgtataaagatgggatcggtgtagttaaaaacttgcgaagggacttttgagttggctttctctgactctgtgttctcgctttggaaaaagacggccatcccttttgtgcaaaacaaatgtaaatattttcttgagatggatgcgattatgattgtctctgtccttgccacagtttttctagagacaatggagagagaaagagagagagagcgcgagagagatcaagacccaagttttgaatctcaaccgaggtccagggcatgacacctcctatgtgggttttcctttcgacgcagtgtaggtcaaaagaatgcatgcacgcttctaaatgaatcttgtctgaatatgtcgtgcaggctgtggtgccgttttccttgtaacaaggatttattagtgaattatcccaagtactccatatatctgtctgtggttgtatgaaatgaaaaaaggggcagagtgcaaagacccacactcacgcacacgcgcttcttctcccacccccacccccttcaaactttattcggaaccttcctttgctgttctggggccgctattgtaaaagcctgggctccctctagtagcttgcgccaccccccctcgctcagttattctgcatgcggggttggctctctctattatcagctttgaaaacttatcctggttttgggaggggtgccgtttttattttcctgaacatttgcttgaaatattttgttagggcctcaaagacgatacctgtctttattttttatatattcttgataactatgatatatttattaataaccagtgtttctggatgagatttcaaataaaaaagaacctttaaatc

SEQ ID NO: 162535 - DNA, 3557 bp, Homo sapiens
  Payload ID: 12013
  Gene Symbol: OPALIN
  Gene Name: oligodendrocytic myelin paranodal and inner loop protein
  Uniprot ID: Q96PE5
  ENST ID: ENST00000371172
  CDS Start-End: 407-832
ccagcctcagcctcatgtaacccattgtttccaaagggctgcaggctgcagaagcccccaagctctcaggccagctgtggcttctttgctgagatggaggtatagccaagaaagcagcctgaaaagtaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcagttaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacctacaaaa

SEQ ID NO: 162536 - DNA, 3578 bp, Homo sapiens
  Payload ID: 12013
  Gene Symbol: OPALIN
  Gene Name: oligodendrocytic myelin paranodal and inner loop protein
  ENST ID: ENST00000393870
  CDS Start-End: 470-859
aatgactccatcattatcagtaacatggttaatgtggactcccgtcagctggggatggagtggccagcctcagcctcatgtaacccattgtttccaaagggctgcaggctgcagaagcccccaagctctcaggccagctgtggcttctttgctgagatggaggtatagccaagaaagcagcctgaaaagtaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcagttaactgttcctacaaatgaaagacacaagccaataaagccagtgagaaaggagcttaccaaaggcagtgtacgaagaaggttcctgggagactgtcagaaatgacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacct

SEQ ID NO: 162537 - DNA, 3545 bp, Homo sapiens
  Payload ID: 12013
  Gene Symbol: OPALIN
  Gene Name: oligodendrocytic myelin paranodal and inner loop protein
  Uniprot ID: Q96PE5
  ENST ID: ENST00000393871
  CDS Start-End: 470-826
aatgactccatcattatcagtaacatggttaatgtggactcccgtcagctggggatggagtggccagcctcagcctcatgtaacccattgtttccaaagggctgcaggctgcagaagcccccaagctctcaggccagctgtggcttctttgctgagatggaggtatagccaagaaagcagcctgaaaagtaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcagttaactgttcctacaaatgaaagacacaagccaataaagccagtgagaaaggagcttaccaaaggcagtgtacgaagaaggttcctgggagactgtcagaaatggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacct

SEQ ID NO: 162538 - DNA, 3581 bp, Homo sapiens
  Payload ID: 12013
  Gene Symbol: OPALIN
  Gene Name: oligodendrocytic myelin paranodal and inner loop protein
  Uniprot ID: Q96PE5
  ENST ID: ENST00000419479
  CDS Start-End: 470-862
aatgactccatcattatcagtaacatggttaatgtggactcccgtcagctggggatggagtggccagcctcagcctcatgtaacccattgtttccaaagggctgcaggctgcagaagcccccaagctctcaggccagctgtggcttctttgctgagatggaggtatagccaagaaagcagcctgaaaagtaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcagttaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacagactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacct

SEQ ID NO: 162539 - DNA, 3392 bp, Homo sapiens
  Payload ID: 12013
  Gene Symbol: OPALIN
  Gene Name: oligodendrocytic myelin paranodal and inner loop protein
  ENST ID: ENST00000536387
  CDS Start-End: 434-673
agtgcagcgaccatccagtgtccttgcagcacgtgttggtctggtgctagcgtgaagagcagtggttaggtcccttgagcaagaggaccctgacctaagaggcccagacgtccctgtgttccaccgtcatcccagaagcagaggtgcacagtgctgtcagcctgggtgctctgattcatccacagagactactggagttgcttggaagccttgcagagtggtggaaagaggttgtcaccgggacactcagagtttttcactgaacttcaccctgccggcgaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacct

SEQ ID NO: 162540 - DNA, 3115 bp, Homo sapiens
  Payload ID: 12013
  Gene Symbol: OPALIN
  Gene Name: oligodendrocytic myelin paranodal and inner loop protein
  Uniprot ID: Q96PE5
  ENST ID: ENST00000611913
  CDS Start-End: 1-396
atgcggatgacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacct

SEQ ID NO: 162541 - DNA, 1417 bp, Homo sapiens
  Payload ID: 12014
  Gene Symbol: OBFC1
  Gene Name: oligonucleotide/oligosaccharide-binding fold containing 1
  Uniprot ID: Q9H668
  ENST ID: ENST00000224950
  CDS Start-End: 169-1275
ccaactgctcctgcgccgggcggggtcgtcgccgccagcggctccgagcgccggaagggccaggtctcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccacttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctcctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttgggaa

SEQ ID NO: 162542 - DNA, 1311 bp, Homo sapiens
  Payload ID: 12014
  Gene Symbol: OBFC1
  Gene Name: oligonucleotide/oligosaccharide-binding fold containing 1
  Uniprot ID: Q9H668
  ENST ID: ENST00000369764
  CDS Start-End: 76-1182
gtgtcccatctagatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccacttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctcctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatata

SEQ ID NO: 162543 - DNA, 7879 bp, Homo sapiens
  Payload ID: 12015
  Gene Symbol: OPHN1
  Gene Name: oligophrenin 1
  Uniprot ID: O60890
  ENST ID: ENST00000355520
  CDS Start-End: 643-3051
tgtgcgtcgcgctctcgccctcctcttcccgctgcagtgtctatggagcgaggctacgtttcattgccgccctggcttaacccttccggcgcctaaaaggacggccggccggccggctcccttgcaccaggaagaagtcttagcagccagcgggccctggtcaggaaactctaaggtacaaggaaaacagttgaggaaggagccagagcgctccggtttggtcctcgggcttcgctggggcggggcgcaggcgttggctttaagaaaggggaggggacagtgcaatccgggttgcccgcggagttcggccaaggaagtcttccgctcgctccggagcgaggagcctgtagagaggctgttcccagctccagctctaacctcgcctacaccttgggcgggcccaagtgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaaattattcttctgctgttcagaaattttcccagacgctgcagtcatttcagtttgatttcattggagacactctgactgatgatgaaattaacatcgctgaatccttcaaggaatttgctgaattgctcaacgaggtagaaaatgagaggatgatgatggtacacaatgctagtgatttgctgattaaacccttggaaaatttccggaaggaacaaataggcttcaccaaggagcggaaaaagaaatttgaaaaggatggtgagaggttttattctttactggatcggcacttacacctgtcttcaaaaaagaaagaatctcagttacaagaggcagacctacaggtggacaaggagaggcacaattttttcgagtcctctcttgattatgtttatcaaatccaggaagttcaggagtccaagaagttcaatattgtggagcctgtcttggcctttcttcatagtctgttcatttctaacagcctgactgtggagctcacacaggatttcctcccatacaaacaacagctccaactcagtttacagaatacaagaaatcatttctccagtacccgggaagagatggaagaacttaagaaaaggatgaaagaagctccccagacatgcaaacttccaggacagccaactattgaaggctatctctatacacaagagaaatgggctttaggaatatcctgggtgaaatactattgccagtatgagaaagagaccaaaacactgaccatgacgcctatggagcagaagccaggtgctaagcaggggcccttggacttaacactgaagtactgtgtgagaaggaagacggagtctatcgacaagaggttctgttttgacatagaaactaatgaaaggccaggaaccatcactctgcaggccctttcagaagctaacagaaggctatggatggaagccatggatgggaaagaacctatctaccacagccctataacaaaacagcaagaaatggagctaaatgaagtgggcttcaagtttgtcaggaagtgcatcaatattattgagaccaaagggatcaagacagaagggttgtaccgcactgtgggcagcaatattcaggttcagaagctgctgaatgccttttttgatcctaaatgcccaggagatgttgattttcataatagtgactgggacattaagacaatcaccagctccttgaaattctacctcaggaatctttctgaacctgtcatgacctatagacttcacaaagagctggtctctgctgccaagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagtaaaatactctttttacaatccatataagcccttgattggaagggcttttcaaaatcatttagtctaacaactgcccagtttccagtcgggggaactgaggcagagcaaggtagtgatcacaccagtacaagatctcaggtcccaggctcctatgcaagttttttttccccattatatcacacttatctagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaacctagataaagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatataa

SEQ ID NO: 162544 - DNA, 1077 bp, Homo sapiens
  Payload ID: 12016
  Gene Symbol: OSTC
  Gene Name: oligosaccharyltransferase complex subunit (non-catalytic)
  Uniprot ID: Q9NRP0
  ENST ID: ENST00000361564
  CDS Start-End: 73-522
ttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 162545 - DNA, 663 bp, Homo sapiens
  Payload ID: 12016
  Gene Symbol: OSTC
  Gene Name: oligosaccharyltransferase complex subunit (non-catalytic)
  Uniprot ID: Q9NRP0
  ENST ID: ENST00000512478
  CDS Start-End: 10-525
gccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccacggagtctcgctctgttgcccaggctggagtgcagtggcgtgatctcggctcactacaaactctgcctcccaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaa

SEQ ID NO: 162546 - DNA, 876 bp, Homo sapiens
  Payload ID: 12016
  Gene Symbol: OSTC
  Gene Name: oligosaccharyltransferase complex subunit (non-catalytic)
  ENST ID: ENST00000613215
  CDS Start-End: 72-323
tagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaatt

SEQ ID NO: 162547 - DNA, 458 bp, Homo sapiens
  Payload ID: 12017
  Gene Symbol: OST4
  Gene Name: oligosaccharyltransferase complex subunit 4 (non-catalytic)
  Uniprot ID: P0C6T2
  ENST ID: ENST00000447619
  CDS Start-End: 51-164
acttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccaggtctttccccctcttttctagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaa

SEQ ID NO: 162548 - DNA, 559 bp, Homo sapiens
  Payload ID: 12017
  Gene Symbol: OST4
  Gene Name: oligosaccharyltransferase complex subunit 4 (non-catalytic)
  Uniprot ID: P0C6T2
  ENST ID: ENST00000429985
  CDS Start-End: 188-301
acttcgggcttgttcgctggtggcgtcggagccgagccggactggtcaggtcagaggcacgcaggggccgtcccacgggccagccccgccgtggccgtggccgtggctggcccgtggggcgaggacgggttcttgcgagggcgaggagtgcgccagcccgcagctcagcccctctcttctccgcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttt

SEQ ID NO: 162549 - DNA, 561 bp, Homo sapiens
  Payload ID: 12017
  Gene Symbol: OST4
  Gene Name: oligosaccharyltransferase complex subunit 4 (non-catalytic)
  Uniprot ID: P0C6T2
  ENST ID: ENST00000456793
  CDS Start-End: 175-288
cgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaa

SEQ ID NO: 162550 - DNA, 3310 bp, Homo sapiens
  Payload ID: 12018
  Gene Symbol: OGT
  Gene Name: O-linked N-acetylglucosamine (GlcNAc) transferase
  Uniprot ID: O15294
  ENST ID: ENST00000373701
  CDS Start-End: 178-3288
tagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaatt

SEQ ID NO: 162551 - DNA, 5461 bp, Homo sapiens
  Payload ID: 12018
  Gene Symbol: OGT
  Gene Name: O-linked N-acetylglucosamine (GlcNAc) transferase
  Uniprot ID: O15294
  ENST ID: ENST00000373719
  CDS Start-End: 218-3358
ggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaatacgg

SEQ ID NO: 162552 - DNA, 556 bp, Homo sapiens
  Payload ID: 12018
  Gene Symbol: OGT
  Gene Name: O-linked N-acetylglucosamine (GlcNAc) transferase
  ENST ID: ENST00000444774
  CDS Start-End: 88-556
gtaaagcaactggagtgtagctgcacaagtacaaggcggttgcccttttagacacttcagtcgcgagcatttgaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttgg

SEQ ID NO: 162553 - DNA, 1935 bp, Homo sapiens
  Payload ID: 12019
  Gene Symbol: OMA1
  Gene Name: OMA1 zinc metallopeptidase
  Uniprot ID: Q96E52
  ENST ID: ENST00000371226
  CDS Start-End: 115-1689
agcgaagggcgccccggccggtatggcgggcaggaagtgcgggtgcgcgcctgcgcataggtcgggtctgcggtgtcaccgctttcgcttctgcttgagtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 162554 - DNA, 2105 bp, Homo sapiens
  Payload ID: 12019
  Gene Symbol: OMA1
  Gene Name: OMA1 zinc metallopeptidase
  ENST ID: ENST00000421528
  CDS Start-End: 1-985
gttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcagcttgtccgggaagagaagtttattgaacagccagaacagattgcagagttaacgctcaacagcttcatccagaacacagaaatctgtcggagttgaaatgtgaaggaaacgcaggctaggaagacacaccagtcttgggaagtgatgaataaatgaaagaaggtcagccaggcggaatgtttctgcttcatctctgctcatatacagtgtagcggccatggaggggtaccactcagatcactcttcaagtgagtcctctgtggcatgcatgactgacaaatgctccagctgtcacaccttcaggcccatggtaactgaatatagcaggggcactagagctgggccgttcctgctgcacatgagatggtgtcatggatgactattgcatgaggactccctgttgacctggccaaaactttcttagaactgcactgtagtcacagctcttcctacttcctcctccttctttcccactctcctttctcgcacttcagactcacatcatggtctgaaggctctctctgcctcctcctgatcctctcctttgtcatgcaccagagcttctccaatacatctcatgcacagctaatcccatcttggtgtctacttcctgaagaatgctaatgcaaagacacagtgactctgtttttcagcccacatgtctctcacctgggaaacagatcaattctatgatatcatcatgcaatggaatactatagggcagtcaaaatgaacgaattagagatataggcatcaacatacatacatctcaaaaagataatgttgagcaaaaacaaaaatgttgcagagtgatacatacagtatgtaacatttatacaaagttttaaaacttgtgaaacaatgtcatatataatttgtagatgagtacatatgtgacaaaagcataaaaacacactaagggctgggtgcggtggctcgcgcctgtaatcccagcactttgggaggccaaggtgggtggatcatgaggtcaagagattgagaccatcctggccaacatggtgaaatcccgtctctactaaaaatacaaaaatcagctgaatgtggtggcacatgcctgcagtaccagctacttgggaggctaaggcagaagaatcacttgaaccccggaggcagaggttgcagtgagctgagatcgcgccattgcactccaccctgagcacagagagagactccatctcaaaacaaacaaacaaac

SEQ ID NO: 162555 - DNA, 744 bp, Homo sapiens
  Payload ID: 12019
  Gene Symbol: OMA1
  Gene Name: OMA1 zinc metallopeptidase
  ENST ID: ENST00000453710
  CDS Start-End: 194-744
gcttctgcttgagtcagtcctcacgctactcatggatgtctttttaagaatgcatacagttctcattctgttgcccacgccggagtgtagtggcacaattttggctcactgcagtctcttgcctcccaggttcaagtgattctcctgcctcagcctcccaagtagctgggtttacaggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagt

SEQ ID NO: 162556 - DNA, 1036 bp, Homo sapiens
  Payload ID: 12019
  Gene Symbol: OMA1
  Gene Name: OMA1 zinc metallopeptidase
  ENST ID: ENST00000456980
  CDS Start-End: 60-1036
ttgagtcagtcctcacggtgacgcttttccccagcttttccgagtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctggg

SEQ ID NO: 162557 - DNA, 852 bp, Homo sapiens
  Payload ID: 12019
  Gene Symbol: OMA1
  Gene Name: OMA1 zinc metallopeptidase
  ENST ID: ENST00000419242
  CDS Start-End: 86-852
gtgcgcgcctgcgcataggtcgggtctgcggtgtcaccgctttcgcttctgcttgagtcagtcctcacggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaa

SEQ ID NO: 162558 - DNA, 836 bp, Homo sapiens
  Payload ID: 12019
  Gene Symbol: OMA1
  Gene Name: OMA1 zinc metallopeptidase
  ENST ID: ENST00000426139
  CDS Start-End: 79-836
ggagcgaagggcgccccggccggtatggcgggcaggaagtgcgggtgcgcgcctgcgcataggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgct

SEQ ID NO: 162559 - DNA, 352 bp, Homo sapiens
  Payload ID: 12019
  Gene Symbol: OMA1
  Gene Name: OMA1 zinc metallopeptidase
  ENST ID: ENST00000482274
  CDS Start-End: 91-352
gcttgagtcagtcctcacggtgacgcttttccccagcttttccgagtaggatcgtgcccaggggaggaggcagagtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagta

SEQ ID NO: 162560 - DNA, 695 bp, Homo sapiens
  Payload ID: 12020
  Gene Symbol: OCM
  Gene Name: oncomodulin
  Uniprot ID: P0CE72
  ENST ID: ENST00000242104
  CDS Start-End: 93-422
cagtgggcctgggaagatgtgtttcccctggatgtgcacattcctgtttgtggcttatcgcctctcatttattctgtgtgagtaggtagaaaatgagcatcacggacgtgctcagtgctgacgacattgcagcagcgctccaggaatgccgagacccagacacttttgaaccccaaaaattcttccagacatcaggcctctccaagatgtcagccaatcaggtgaaggatgttttccggttcatagacaacgaccagagcgggtacctggatgaagaagagcttaagtttttcctccagaagtttgagagtggtgccagagaactgaccgagtcagaaaccaagtccttgatggctgcggcggataatgatggagatgggaaaattggagcagaggaattccaggaaatggtgcattcttaaaagccccagtctctggagaaaagagagaaagggataatcacctggaaggattccaaagccctgggaatggggaaccccacatcccatccctacctaatttgttaattttccctgaaaaccttctgcagtttgctcattgttttagtgaggtcacgagggagtcactcctgactttcttggtggtgggtatatgccctgacaacttctgtaagccccccttcccccaacaggcaatgcctctaaaaatcacccaataaagacaggcttctcatc

SEQ ID NO: 162561 - DNA, 623 bp, Homo sapiens
  Payload ID: 12020
  Gene Symbol: OCM
  Gene Name: oncomodulin
  Uniprot ID: P0CE72
  ENST ID: ENST00000416608
  CDS Start-End: 141-470
ggaaatctaagaggttgtaactatcactttttctagcctatataaggtaggtcagtaaggtagcaaaaacacatctgttgttttgctccttcaactctttttcctgattcttcctggggggaaaccgaaaacggtgaaaaatgagcatcacggacgtgctcagtgctgacgacattgcagcagcgctccaggaatgccgagacccagacacttttgaaccccaaaaattcttccagacatcaggcctctccaagatgtcagccaatcaggtgaaggatgttttccggttcatagacaacgaccagagcgggtacctggatgaagaagagcttaagtttttcctccagaagtttgagagtggtgccagagaactgaccgagtcagaaaccaagtccttgatggctgcggcggataatgatggagatgggaaaattggagcagaggaattccaggaaatggtgcattcttaaaagccccagtctctggagaaaagagagaaagggataatcacctggaaggattccaaagccctgggaatggggaaccccacatcccatccctacctaatttgttaattttccctgaaaaccttctgcagtttgctcattgttttagtgaggtca

SEQ ID NO: 162562 - DNA, 696 bp, Homo sapiens
  Payload ID: 12021
  Gene Symbol: OCM2
  Gene Name: oncomodulin 2
  Uniprot ID: P0CE71
  ENST ID: ENST00000257627
  CDS Start-End: 93-422
cagtgggcctgggaagatgtgtttcccctggatgtgcacgttcctgtttgtggcttatcgcctctcgtttattctgtgtgagtaggtagaaaatgagcatcacggacgtgctcagtgctgatgacattgcagcagcgctccaggaatgccaagacccagacacttttgaaccccaaaaattcttccagacgtcaggcctctccaagatgtcagccagtcaggtgaaggatgttttccggttcatagacaacgaccagagcgggtatctggatgaagaagagcttaagtttttcctccagaagtttgagagtggtgccagagaactgaccgagtcagaaaccaagtccttgatggctgcggcggataatgatggagatgggaaaattggagcagaggaattccaggaaatggtgcattcttaaaagccccagtctctggagaaaagagagaaagggataatcacctggaaggattccaaagccctgggaatggggaaccccacatcccatccctacctaatttgttaattttccctgaaaaccttctgcagtttgctcattgttttagcgaggtcacgagagagtcactcatgactttcttggtggtgggtatatgccctgacaacttctgtaagccccccttcccccaacaggcaatgcctctaaaaatcacccaataaagacaggcttctcaaca

SEQ ID NO: 162563 - DNA, 2365 bp, Homo sapiens
  Payload ID: 12022
  Gene Symbol: OIT3
  Gene Name: oncoprotein induced transcript 3
  Uniprot ID: Q8WWZ8
  ENST ID: ENST00000334011
  CDS Start-End: 219-1856
aaagcagtgcttctctctggggccaaggccagagctgtggacaccttatcccactcatcctcatcctcttcctctgataaagcccctaccagtgctgataaagtctttctcgtgagagcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatgacatctgcgacgaggactgccatggcagctgctcagataccagcgagtgcacatgcgctccaggaactgtgctaggccctgacaggcagacatgctttgatgaaaatgaatgtgagcaaaacaacggtggctgcagtgagatctgtgtgaacctcaaaaactcctaccgctgtgagtgtggggttggccgtgtgctaagaagtgatggcaagacttgtgaagacgttgaaggatgccacaataacaatggtggctgcagccactcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgaggtcctgaaatactacctcatccgggatggctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttataccttgaaatttcaattcaaatgcagactaattatagggaatttggaagtgtatcaataaaacagtatataattttaaaa

SEQ ID NO: 162564 - DNA, 1602 bp, Homo sapiens
  Payload ID: 12022
  Gene Symbol: OIT3
  Gene Name: oncoprotein induced transcript 3
  Uniprot ID: Q8WWZ8
  ENST ID: ENST00000622652
  CDS Start-End: 216-1181
gcagtgcttctctctggggccaaggccagagctgtggacaccttatcccactcatcctcatcctcttcctctgataaagcccctaccagtgctgataaagtctttctcgtgagagcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatgacatctgcgacgaggactgccatggcagctgctcagataccagcgagtgcacatgcgctccaggaactgtgctaggccctgacaggcagacatgctttgatgaaaatgaatgtgagcaaaacaacggtggctgcagtgagatctgtgtgaacctcaaaaactcctaccgctgtgagtgtggggttggccgtgtgctaagaagtgatggcaagacttgtgaagacgttgaaggatgccacaataacaatggtggctgcagccactcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcac

SEQ ID NO: 162565 - DNA, 1854 bp, Homo sapiens
  Payload ID: 12023
  Gene Symbol: OSM
  Gene Name: oncostatin M
  Uniprot ID: P13725
  ENST ID: ENST00000215781
  CDS Start-End: 42-800
gtcacccccagcgggcgcgggccggagcacgggcacccagcatgggggtactgctcacacagaggacgctgctcagtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcaccccttgccggtgaaggatgcggcaggtgctctgtggatgagaggaaccatcgcaggatgacagctcccgggtccccaaacctgttcccctctgctactagccactgagaagtgcactttaagaggtgggagctgggcagacccctctacctcctccaggctgggagacagagtcaggctgttgcgctcccacctcagccccaagttccccaggcccagtggggtggccgggcgggccacgcgggaccgactttccattgattcaggggtctgatgacacaggctgactcatggccgggctgactgcccccctgccttgctccccgaggcctgccggtccttccctctcatgacttgcagggccgttgcccccagacttcctcctttccgtgtttctgaaggggaggtcacagcctgagctggcctcctatgcctcatcatgtcccaaaccagacacctggatgtctgggtgacctcactttaggcagctgtaacagcggcagggtgtcccaggagccctgatccgggggtccagggaatggagctcaggtcccaggccagccccgaagtcgccacgtggcctggggcaggtcactttacctctgtggacctgttttctctttgtgaagctagggagttagaggctgtacaaggcccccactgcctgtcggttgcttggattccctgacgtaaggtggatattaaaaatctgtaaatcaggacaggtggtgcaaatggcgctgggaggtgtacacggaggtctctgtaaaagcagacccacctcccagcgccgggaagcccgtcttgggtcctcgctgctggctgctccccctggtggtggatcctggaattttctcacgcaggagccattgctctcctagagggggtctcagaaactgcgaggccagttccttggagggacatgactaatttatcgatttttatcaatttttatcagttttatatttataagccttatttatgatgtatatttaatgttaatattgtgcaaacttatatttaaaacttgcctggtttctaaa

SEQ ID NO: 162566 - DNA, 1000 bp, Homo sapiens
  Payload ID: 12023
  Gene Symbol: OSM
  Gene Name: oncostatin M
  ENST ID: ENST00000403389
  CDS Start-End: 290-985
ggagggaggcaagagaggtcaggggagagccctggccttgtgtgacctgagtaggaccttctcctgagacttggtttacctgtcaggaaagtggggacatggactggaaggtcttccacatctgttccaggctgcacctctggttgaaaaggcagcctctcctggttctagacagagctgaggacacaagctgctcccgggctgcctgccctgaagccctctcaggcccatctacctggatggccagagcagctgacaaggtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcacccc

SEQ ID NO: 162567 - DNA, 464 bp, Homo sapiens
  Payload ID: 12023
  Gene Symbol: OSM
  Gene Name: oncostatin M
  ENST ID: ENST00000403463
  CDS Start-End: 41-103
tcacccccagcgggcgcgggccggagcacgggcacccagcatgggggtactgctcacacagaggacgctgctcaatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctg

SEQ ID NO: 162568 - DNA, 5539 bp, Homo sapiens
  Payload ID: 12024
  Gene Symbol: OSMR
  Gene Name: oncostatin M receptor
  Uniprot ID: Q99650
  ENST ID: ENST00000274276
  CDS Start-End: 403-3342
gcgcttgccccgcagctgattcatagccccggcccgggccgcctctgcacgtccgccccggagcccgcacccgcgccccacgcgccgccgaggactcggcccggctcgtggagcccttcgcccgcggcgtgagtacccccgacccgcccgtccccgctctgctcgcgccctgccgctgcgccgccctcggtggcttttccgacgggcgagccccgtgctgtgcgggaaagaatccgacaacttcgcagcccatcccggctggacgcgaccgggagtgcagcagcccgttcccctcctcggtgccgcctctgcccagcgtttgcttggctgggctaccacctgcgctcggacggcgctcggagggtcctcgcccccggcctgcctacctgaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgagtttatttaatgaatccttttagtgtcaactttgaaaatgtaaatgccacaaatgccatcatgacctggaaggtgcactccataaggaataatttcacatatttgtgtcagattgaactccatggtgaaggaaaaatgatgcaatacaatgtttccatcaaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacaaagaggttgaggaagaaagaattgcaggcacagagggtggattctctctgtcttggaaaccccaacctggagatgttataggctatgttgtggactggtgtgaccatacccaggatgtgctcggtgatttccagtggaagaatgtaggtcccaataccacaagcacagtcattagcacagatgcttttaggccaggagttcgatatgacttcagaatttatgggttatctacaaaaaggattgcttgtttattagagaaaaaaacaggatactctcaggaacttgctccttcagacaaccctcacgtgctggtggatacattgacatcccactccttcactctgagttggaaagattactctactgaatctcaacctggttttatacaagggtaccatgtctatctgaaatccaaggcgaggcagtgccacccacgatttgaaaaggcagttctttcagatggttcagaatgttgcaaatacaaaattgacaacccggaagaaaaggcattgattgtggacaacctaaagccagaatccttctatgagtttttcatcactccattcactagtgctggtgaaggccccagtgctacgttcacgaaggtcacgactccggatgaacactcctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaaggagaaccctcacctaataataatgaatgtcagtgactgtatcccagatgctattgaagttgtaagcaagccagaagggacaaagatacagttcctaggcactaggaagtcactcacagaaaccgagttgactaagcctaactacctttatctccttccaacagaaaagaatcactctggccctggcccctgcatctgttttgagaacttgacctataaccaggcagcttctgactctggctcttgtggccatgttccagtatccccaaaagccccaagtatgctgggactaatgacctcacctgaaaatgtactaaaggcactagaaaaaaactacatgaactccctgggagaaatcccagctggagaaacaagtttgaattatgtgtcccagttggcttcacccatgtttggagacaaggacagtctcccaacaaacccagtagaggcaccacactgttcagagtataaaatgcaaatggcagtctccctgcgtcttgccttgcctcccccgaccgagaatagcagcctctcctcaattacccttttagatccaggtgaacactactgctaaccagcatgccgatttcataccttatgctacacagacattaagaagagcagagctggcaccctgtcatcaccagtggccttggtccttaatcccagtacgatttgcaggtctggtttatataagaccactacagtctggctaggttaaaggccagaggctatggaacttaacactccccattggagcaagcttgccctagagacggcaggatcatgggagcatgcttaccttctgctgtttgttccaggctcacctttagaacaggagacttgagcttgacctaaggatatgcattaaccactctacagactcccactcagtactgtacagggtggctgtggtcctagaagttcagtttttactgaggaaatatttccattaacagcaattattatattgaaggctttaataaaggccacaggagacattactatagcatagattgtcaaatgtaaatttactgagcgtgttttataaaaaactcacaggtgtttgaggccaaaacagattttagacttaccttgaacggataagaatctatagttcactgacacagtaaaattaactctgtgggtgggggcggggggcatagctctaatctaatatataaaatgtgtgatgaatcaacaagatttccacaattcttctgtcaagcttactacagtgaaagaatgggattggcaagtaacttctgacttactgtcagttgtacttctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagagattgggttttaccatattggccaggctggtctcaaactcctgaccgcaggtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctgacctcaggtgatctgcctgccttggcctcccaaagtgctgggattacaggcgtgagccactgcgcctagccgtcacatttctaaacaagcatgaaaggggttcatttttgtcttcttcttgcctgccgtcagcatggtggaaatggctctgcctatgctcatgcttctggtgcccaatgccttgcactgtgccattcaacactatgaagagaaacaagtagccacacctcaaaataatgtggctgtcaacaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatca

SEQ ID NO: 162569 - DNA, 1740 bp, Homo sapiens
  Payload ID: 12024
  Gene Symbol: OSMR
  Gene Name: oncostatin M receptor
  Uniprot ID: Q99650
  ENST ID: ENST00000502536
  CDS Start-End: 283-1311
gcggccgcctccccccgggactgaagggagggaattcctgtgggtcccaggagtgccaagagtgcgcagcaagacgggaaattgcaaaagacctcacccctctgccctcccccgcggttttccagtaactcccgcccctccgcgcttgccccgcagctgattcatagccccggcccgggccgcctctgcacgtccgccccggagcccgcacccgcgccccacgcgccgccgaggactcggcccggctcgtggagcccttcgcccgcggcaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgaggtgagactagagttgtcacagcccaccgtggccactaacgtgtctttgtttcacagactgtgtgatcaagtaaatgtgctgtagatctttgcctcattcacagcggaggtgagagttagaatttatacctattgttcatgccacgtttctcctcatggatgcacgcatcccctattatttgtttcttttaataatgtcacgagcaccaatgagcttactacccaacttcaaaactaggactctaacaataacttctgtcatatctcatcctgtaacgcccccaccttcgctccttccgccaagataattatcactttaaattgtgtgcgtgtgtattctcatttcttatgtgatggtaaaaatgcctttattttgtttggttttaatgcatagaaaggacatcaagctgtatgtaataattcagtaattatgtttatataatattaaattgctaatatttgcccata

SEQ ID NO: 162570 - DNA, 361 bp, Homo sapiens
  Payload ID: 12024
  Gene Symbol: OSMR
  Gene Name: oncostatin M receptor
  ENST ID: ENST00000508882
  CDS Start-End: 1-107
ggatcaaggagacctgttatcctgacatccctgacccttacaagagcagcatcctgtcattaataaaattcaagatctcttcaaaagtctggcttaatagaagatagctggattctcatacttgcttctacattcaatctgttgccatatgttgttttggctgaagtattaaagaaaatctagcctcacacagctgagccttcttgagacaccccatcactgcatccagaaatccccgaaaacttagagggaaccacttctaaaggattatggatagtctgctcacaccaatcagaatatggaatatcttgaaagtctgaagaaaaaaataattatttcaattaaagcaccataacggctt

SEQ ID NO: 162571 - DNA, 766 bp, Homo sapiens
  Payload ID: 12024
  Gene Symbol: OSMR
  Gene Name: oncostatin M receptor
  ENST ID: ENST00000513831
  CDS Start-End: 1-567
ctggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacagtgtgtcaacgtgtttcagtgggacagtcccctcagtgtggggagaaggagacttcagccatggctcaggacatttctgtccaggggattcttcaacatacatgggaaattatctcaaatttattcaagtaactgcaaccctaacaaacagtcaccactgagagttggagttactatttatgatctttgtggcttgtgaaataggaattgcatttactattttgtaaaaagtgttgtcagtctttgcacctggaaagagtccatgaacatttccagagatcatcagaactggcatcaactttcaccacagactctgccaactttgtagaataaaagataataactggctaatctcttgcc

SEQ ID NO: 162572 - DNA, 653 bp, Homo sapiens
  Payload ID: 12024
  Gene Symbol: OSMR
  Gene Name: oncostatin M receptor
  ENST ID: ENST00000509237
  CDS Start-End: 1-188
cctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaagatctcttcaaaagtctggcttaatagaagatagctggattctcatacttgcttctacattcaatctgttgccatatgttgttttggctgaagtattaaagaaaatctagcctcacacagaaaatgaaaataactacagcatgcaaagggcctggacagggctgttcacagtggaaaagacctaatccagggatctgtcagactcaggccccactgtgacctggaaccgtgagaggatcagcatctcagcataacataatttggcatatcagtgtgctgcagctcaccagctgggaaactctgaattagaataccaaaaagaaatttggaaaagtaaaccagagaactttagtcatcactaggtttttctgaaggtgggacgtgatcacttacctgaatgactacatattgcactcagttggttgctgggctggaaacccagaatttcaatacagacacaataaaggcagttatcatctgtatgttcctgtagtccagt

SEQ ID NO: 162573 - DNA, 2092 bp, Homo sapiens
  Payload ID: 12025
  Gene Symbol: ONECUT1
  Gene Name: one cut homeobox 1
  Uniprot ID: Q9UBC0
  ENST ID: ENST00000305901
  CDS Start-End: 129-1526
ccccacagtgagaggaaggaaggcaacagtcgccagcagccgatgtgaagaccggactccgtgcgcccctcgccgcctctgcctggccacatcgatgttgtgtccgccgcctgctcgcccggatcacgatgaacgcgcagctgaccatggaagcgatcggcgagctgcacggggtgagccatgagccggtgcccgcccctgccgacctgctgggcggcagcccccacgcgcgcagctccgtggcgcaccgcggcagccacctgccccccgcgcacccgcgctccatgggcatggcgtccctgctggacggcggcagcggcggcggagattaccaccaccaccaccgggcccctgagcacagcctggccggccccctgcatcccaccatgaccatggcctgcgagactcccccaggtatgagcatgcccaccacctacaccaccttgacccctctgcagccgctgcctcccatctccacagtctcggacaagttcccccaccatcaccaccaccaccatcaccaccaccacccgcaccaccaccagcgcctggcgggcaacgtgagcggtagcttcacgctcatgcgggatgagcgcgggctggcctccatgaataacctctataccccctaccacaaggacgtggccggcatgggccagagcctctcgcccctctccagctccggtctgggcagcatccacaactcccagcaagggctcccccactatgcccacccgggggccgccatgcccaccgacaagatgctcacccccaacggcttcgaagcccaccacccggccatgctcggccgccacggggagcagcacctcacgcccacctcggccggcatggtgcccatcaacggccttcctccgcaccatccccacgcccacctgaacgcccagggccacgggcaactcctgggcacagcccgggagcccaacccttcggtgaccggcgcgcaggtcagcaatggaagtaattcagggcagatggaagagatcaataccaaagaggtggcgcagcgtatcaccaccgagctcaagcgctacagcatcccacaggccatcttcgcgcagagggtgctctgccgctcccaggggaccctctcggacctgctgcgcaaccccaaaccctggagcaaactcaaatccggccgggagaccttccggaggatgtggaagtggctgcaggagccggagttccagcgcatgtccgcgctccgcttagcagcatgcaaaaggaaagaacaagaacatgggaaggatagaggcaacacacccaaaaagcccaggttggtcttcacagatgtccagcgtcgaactctacatgcaatattcaaggaaaataagcgtccatccaaagaattgcaaatcaccatttcccagcagctggggttggagctgagcactgtcagcaacttcttcatgaacgcaagaaggaggagtctggacaagtggcaggacgagggcagctccaattcaggcaactcatcttcttcatcaagcacttgtaccaaagcatgaaggaagaaccacaaactaaaacctcggtggaaaagctttaaattaaaaaaaatttttaaaagaccaggacctcaagatagcaggtttatacttagaaatatttgaagaaaaaaaagcgttatttatagtccaaagaaaccaaagacttagctcacctgcattctgactttgtttggagacacacacttcagcagggcggcgacttggcaagacaaatgatgagcaggaaaacaccactggatctcacaccttcaatccatgaccatcctcgctgtgcttggctgtttagtggtttggagcatagtgattttgagccattgagcggacatcttttaagatcgaactttctcatctgttctaccatgccacgaaggtgtatggtgtctcagtactaccaccaccagtggttacagacttaggcagagctggtcttcagaaatggttgttctataggagtgcaaccaacatggtatggggttgtctgagttcattggattaggagtgtgattttgctcgtctagcctaacgtttgaacctgccaggcccgcaacctaaatgcagattca

SEQ ID NO: 162574 - DNA, 996 bp, Homo sapiens
  Payload ID: 12025
  Gene Symbol: ONECUT1
  Gene Name: one cut homeobox 1
  ENST ID: ENST00000560699
  CDS Start-End: 562-762
ggtcccttgccttgaggggggcccaagggctcagatcttcccataccttcaggcattggcattctgatctgcacttggacagcaattacacttcttggctccacatcagtgcctgccttgctatttcaaagattgcctgtaactcaaattttagggctctgcactaaaaagtaataaattgaccaaaacagagtatataggctgggagttgtctagagggcatcttgcaatttctgtcaaacactgcatgtttccagtcaccatgtgtttctcatcttcctttgcatatgccgccacgggatattcagaatcgacggtttctgaaatcactgctttcgttttcacatctggtgatgatctcatagtcccaaagagaggttatcgaaggaacgcaataaactatgtgctttttgctttctttcctgttgtcttctaaaacagatcaatggggaaaattaaataaacaaacgagcgaagcgcgccacctagtgacctctgtgctcgctgcagattctgcgactgaagtgcgtgagaggagtggctaaagcgattcgagtattgatggagtcacaaaaatcgttcattaagcatgcaaaaggaaagaacaagaacatgggaaggatagaggcaacacacccaaaaagcccaggttggtcttcacagatgtccagcgtcgaactctacatgcaatattcaaggaaaataagcgtccatccaaagaattgcaaatcaccatttcccagcagctggggttggagctgagcactgtcagcaacttcttcatgaacgcaagaaggaggagtctggacaagtggcaggacgagggcagctccaattcaggcaactcatcttcttcatcaagcacttgtaccaaagcatgaaggaagaaccacaaactaaaacctcggtggaaaagctttaaattaaaaaaaatttttaaaagaccaggacctcaagatagcaggtttatacttagaaatatttgaagaaaaaaaa

SEQ ID NO: 162575 - DNA, 1638 bp, Homo sapiens
  Payload ID: 12025
  Gene Symbol: ONECUT1
  Gene Name: one cut homeobox 1
  ENST ID: ENST00000570208
  CDS Start-End: 1-547
cctctataccccctaccacaaggacgtggccggcatgggccagagcctctcgcccctctccagctccggtctgggcagcatccacaactcccagcaagggctcccccactatgcccacccgggggccgccatgcccaccgacaagatgctcacccccaacggcttcgaagcccaccacccggccatgctcggccgccacggggagcagcacctcacgcccacctcggccggcatggtgcccatcaacggccttcctccgcaccatccccacgcccacctgaacgcccagggccacgggcaactcctgggcacagcccgggagcccaacccttcggtgaccggcgcgcaggccatcttcgcgcagagggtgctctgccgctcccaggggaccctctcggacctgctgcgcaaccccaaaccctggagcaaactcaaatccggccgggagaccttccggaggatgtggaagtggctgcaggagccggagttccagcgcatgtccgcgctccgcttagcagggacagcgagggaagctcgtacggcctgaggcggagagaaatccccgcacctggtgagacactctgcgccacctctcagttcagcgatccgggtttgggaagagggatgcaacgcgtgcgtggaatcgcacgcaaatgttcctcgcaggtacctctgacacatcccaggcgctgggctggagcgtgccggagcagcgtcgatgtttggccgaactggctgctgtgaccccctcccgcgctcattcttttggcgctggctggggtgacctcaatctaagagtatgggcaaaaagtttcagagccattgggcggtgggtgtgtagcacagacgagttgtaagggttaggacgctctctgcgcatggaattggctgtggaaaggagagggaggctgaccgtcccaaggtcccagtgagagctgcaaagcaatagccatgtcctgggaccgactccgctgccgactccctgaggactttgcattttgttttattattcctcttcgcgattttcgtctgaatccccgtgcgggaggggggtttggggatgagagtgtgtaaatgacccccaagtctaggagcagaggtctcctgcccgaaaccccaagccccaggtgtttctgagttcagctggaagctctccttggcgcagcgcagacaccgcgcctggctccccgagaccgcggataggcagagaagaaagctgagcccagcccgaaccccaccggggatttcaggaggattcggcgacccttgaggctcttgtgctaccggcaccatatctccacccgtgggctgcccgcgagcaactgaggttccggagggagtgggcgaaggggctgctcctcgtcctgactgctccgtctctccagagcccaagcgggagagtggtggcttctccacgcccctctgtcctccagttgccggcagcctgttgcagagggtcaaaaccctcttgcacgtggcgctgtgtttggggaggcgccttccggtcacgaaataacagcggctggtggaagaagggcgacaggaggaaattcccaccaaattaactaccttttaaaaatcaatatatgttccctccatgtactacttgctgctgccccattaaagagcagagcgaca

SEQ ID NO: 162576 - DNA, 16121 bp, Homo sapiens
  Payload ID: 12026
  Gene Symbol: ONECUT2
  Gene Name: one cut homeobox 2
  Uniprot ID: O95948
  ENST ID: ENST00000491143
  CDS Start-End: 33-1547
gcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaacgagaatgacctcatttgctttccacatgcttagcctcattataccatgttatgtccaagttcacagccacaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatatggcttcaagcacattttgcagtttgctacaaattctgttgtacataatgcagacgcacactcaggaggccaatttaactgttaacagtgcatggagcgaatgcagcattttaaaagatctaggtttttttaggtcattaatgtgtccttggttgatcagtcatctggtccctcctactgtgtgttatgaccaccacgtaatccattctcgctctttctgatttggggtttttcctcatccatcccattagtagggatgttttctgtgttttctagcaagaaaaaaaaatcaatcaatcaaacctgcatacatgttactcatgactgtcatctagtcctaaatctcttctgttgttgaatcatccttgcaaaacagctgaatacatctggagaaaacacagcacaccaaagaagcagaatactgcaaaccaaagacatttatgacttgtcattttctagcctaaaaatactgtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatcattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccagaaaataaacgaaaacaaaaacagggagacacactgtgttcaaacagacctcttgggacattttttggaagcagattttaaagaaagggttgagacaaagatagaaataaggaagagcctcagtggctgctgcttcatttgacaactcacacggtaatcttaaagctgaagattgtctttaatttgtgcctatgcagtttttcaaaagaacacggaacagagcaacagaaacctcaacagctacaataccaaagatgaggatttctcacaccttttgtttcagttcattatctcctcttgcctggctaaaatactaatagcgccattgaactgtataaaggtaatcaattatgtttctctgagcaacaaaaggaaagggccatttatttgattttattgtttcatttcaattttgtcttatggttttttgccccaacatggaatctctcaaaagtttccatggactccaagtttaagatgttgggatattgaacagttctctctgctcagcagagggtagggaataacattatcacttgaatgttctttgcttaacccttagacttggttccttctatgttcagagtctcatcatcaggggaaggaaagggagtgagggtcagggataggggtcttggtgatgcatcctctcccgagccacagaaccaaagagtttatagaggaatttacagcctcgttttcatgtgattgctacatcctaacagggcttcatttgggggtggggggaaacatgtaaaaataattgccagtttctacttttctattagctttttaaaaatcagctgtaaagttgcatttctaaagaaagatatatataatatataaaatacatatatagatcaacttgacattggtgataaccaaaattattgctgtccaaattcatgtcttgttttggtccagtgcttcatttgctaagtattcggttcagaatttttctcatttctcatgccattccagagttaatttgccactgtggatgatttgaagtattcagatctctatggaagtttctgggacaggtttaaagtcaagatcaagcattttagcatttaacctgttgataaatggatccatggtgtacatgagttttatttgtattcggagtcatctctattctatccctcagcctcgattaaggtggtgagtgaagtgcatccaacagactcggcccagaactgggtcctgacagtggggtgctcatcttctgtaactgttgggaaggctcggtggtccattttcaccagttaaagaatatgaggccagcccagaaatctgttctccaggagctgccctgtcccatctgggtgtgccagaccccctcagtgagcaggtccaccaaagggacttctcacaggggaagcccaactcctgttgcaatgggttgatagatttcctcagggtggtaattaccaattcgtattttgacaagcctatgtgcaaccacagctggcactggggtgggcagtggtgttgggtgggatgggggagagtgtctcaatcctgaagagaaaatataaagcaggttttggggagacttctggagtcctgcccctagagagccccattgttgttctttgtgccccctcctcattccccctatgtgggtctccctatgcaggagctgtgagagaatgtgactctccacaatttttataattcatccttcctaggagattgttcattggctcttcccttgtgtccctttgtcccttgctcatactccatgtttcctttgtcaaaggactaagaaaagagcatatttcagcagaggagtgttcccatgtgggttgatttcaacttgggtatttctaaaagagtccttgtgacatgtgtccagtggaaatggttgctcttttccagactggattgaggaatggagcctgtttgatttggttagtgattctttgacatactaatctcagcgtttgggtctccagcatcctctgaagatgtctagactagtagaggctgcctttgtgacctgacattacaacattggtcaaaccagtcctctgataatcagaagaacatgtcataattgtttaaaaaaaaaaaaaaggcaagaatttctctccaaggagctttaataaatgtctcattccagataatgtcataccagagaaaagtgcttgcttttagaaaattatttacatacatatataaatatatatgtgtatctatacagttatgtatcaaaattttaagccctgcagaatttcaatttgttagaaatctaacagaaaaaaatttctatattgaaaggtaatagaatttaacccagtgagtttactcaaggatttttaaatttaagttaataatttcagagaaaataaccatttgggtgtggttatagtttagtatccattacctcaatccaaggaaaattccaggcattcctcaaccatcaggaaaaggtacagtgtgaaggaacagttctcagccaaatttcacattcttgaggcaacagaaatcaaaacactcagagccattgagtggaaaaacaatttactttattcctttacacaaataggcttgcattgtttttgttttaatgtgattttggtactagggatataattatttcattccaggaaataataaaaaaaaacagacagagccaatacatttctttttttaaaggaaacagcaacaacaataaaaactcagcaccaatatttaaaagcttttccaaaatgtaaaagaagtgtttagcttgcaccatgcataaaggtgcaggctagttgaaccaggaagcatggcacttcctctggagaaatccagaaagagttgcttctaagctcccttttccccctgcaggctcttggcaattgtaggctttagcaaatccagaataattttcaattcaagctaaaataaaatcaacatttggaatgtaaatctgatacacacacacttttctaagtcaaacaacatatttcaaaaccaaaaataaataccttttagataatcagttattttctttgtctatactgggcacccacctactagtgccagtaaattcaagttgaacagatttttaaaatcactattatctgggtatgggggaaacttccccacttttgaaaatgttggtagaattataggaatgtctgtttgattatcattaccaaagtgtcatgacagtatgcctttgtagtgaactcggattttcaggagtttgaatagttggatattttaaaatctaagaagaaaaggcctgtttccaatgttgttgaagaataatgaactctattaaaaagtggagaaaaagataatacatgtggtcaaggttgaccacaaggcccaggcacaactaccttggcgataatcttctagattcgtaacaggttagagctgactttttgtttttgttgttgctgatgctgtgtgattcagacttctcagcctaaccaggaagagtaagtggaaatggtagatgaagaaggggtagagctggtgtatctataactttctgatatttgtctgccaaacttgatatattagtaatttttttatctttagctaagatcaagtcacccctgaaacaacaggagattctagttttaaaataaggccacaaaaatccttacggaatgaagaatggcaccccagttggttgtataagtctcataagataatgatgttgattttaaatatggatgtctcaatgcctgttttctatcaatgatttgtttgtttccaaggtcggggagggaaagaggggagggtttatctgttttagaaagtctcagaatacttataaaatacagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggacaaaaagaaaaaaaaaaaaagaaaaaacaaagaaaaagaagaaaaaataataaagtcaagcgcaaactgatggggagacagtgggctctggtttccaggattgagacaatggtactgcggtcttggggagactgcgttagctagtggggagtggtgatttttttcatgcttgtcacatctaaatggtctttaacatgagaaagttttagaggttataatttcctgctttgtttttatttagactatcaaatgaagttatacatgttgtcagtcaaaaaatgaagacaccctctgccccaccccacagaatgctttttatcttgtctctttgggttatgacccaacaagctaagtaccattaatgtaattaacttatttaaattagttcctagtacataaatgtataggatttgggtaattatttaatcatccttccttagtttgattctactccttgtacttatttatcaaaacctagaccaatggtgcatcagagatgcaaaattctacttggaatactcttgaagtttagtttgctttataaagcagtgaaattctgttacagacagggaagaaatacaggttacaaaaagagaatttgggatattcttccctcttaaattaacttttaaaatagtctaagtaacaatttttaaattatttaacttaagttcgcagccccacctggtaccaggcgaacttcacctcttaattattgtggccctcggagccttcatattgtaacttatttatttaacttattcagcatctgtgaaaggtgcactgtatagtttatatttttaatttaaaacaacagagagcactgcagtttgtttgctgtcagaacaacagagcaaattttgtggacaagcaatgactattcagcctgaacctgtgcattcagaaaacataagctgagaccctgcttcaccagcctggatttcggggcttctatacagaaactggaaaaataaattttaaaaaaatcgtaaacaaaaagagagaaacccttacactagctgcttccaagaatgaactctgtgtgtatgtaaagcaacaaaacaaaaaaggaaaaaaacaaaaagcagaaaaaagaaaaaaaaaatgaaaaactttctatttctagtgagaaccaaagaaggctacctcactgactttttccatttgtaattttaatcgtgttgatgacaccaaagataccaaagatttctttctctgtgcggtctgcattttgcttgtgctcttttataatttgaacgattttctctgacatatggtatgtacagccacagctcagataccccaaagaaataattatctatgcgacggcggctgctaatttggaaagggatattttctgtgtttctcttatatgtttgctgtctgctcgacatgttcaagatgcgagttcagatgctgctgtaattggattccttaaattctgattacaaattgaggaaggaaactggttggaaatggccttcagtcctagccatggcctctatccccgctgggacctgtcacagtaaagactgccaattactgaaccacagaagctctgaccattgagtagttgagctggaagagaccttaggaatcatttagtccaagccccggtggcccagaggaatgaaatagttatccaaatcaaataactcttgagagtgaaagcccacacatgcctcctggttcctgccccagtgctccgcttattgtacagtgctacctctgcatgagagcggtcccacattgacaaataggatggtggcaatcctttagcaatgagcagggactggggtttatctcttaacattttcagctgtaaaattagtcacaagcattttcagtgtcccattagtacatagtcacatatggtcggttgcttcgtgaaggtggcctgtcttgaaatactagggctcatacgggatttttgccctaggaaaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatagctagtagaggaatataaatgacagattgacaaactgtaggaaacactgttactctctttctgaagttttcaagcaccatcctatgtgaaagttccctcctgtccaaacaagctcaaggcccatcttctccctatacaaggcaaacctgtaaggccttccttccaaagagtacattgctttggttttcttcctaaattcctattggaattagaactctcagaatccctgggagacagagcaaagatgacttaattcattgagcagcagagctccctataagtgaacatcaccttccccatctttcctactgccacacccatacgagagaggatctagaaagagcgatggcagcctgaacacagaaaacatccccacttggcagacctctcctcagcaatccccccagcctcatgcttcacttgcaaagtgtgacataaccacgggacgagtgccttgcttgaaccaaagcaacgatttagccagtctggacctctctgtgctttttttaattcttcctgtgaatacctcagcttcaactgggcctccatacagtcagttggtgggcttattgtactgtggtgctttgcaatgcaaccctgcaaagaacaagatttgtactaataccaaaggttctttctctatgtctcctcctctgcctccctcgttcttcccttttttctagttcttcacggttccaaagctttactatgaacctgggcatgttggcaatgcagaccgcgcaattccttaccgaattttctcagatatacctcatagacaatagtgtttagagtaatgttattatagcgtatgtaataaattattcactgtttcttttggtaactgtgatttaaaaaaagaaaaaagaaaaaaaagctttatacgttttaggttgtgcttttgtaatagatgaaaaaaggtgcgcttaaaaagaaaatgtatgtttttttccccctttggattttatttatgctggattggggaaagttgcagaatgagcccaaagtttacagtttcatattttgctgaagaaacaatctgtgttcatttgctctgttgaaaagaataattattttctacatttgtgccacttggtctgaacaattaattgttccgtgttaacagtgtagtattatgattagcaactgccaatcagtgctataattttatgcatgaggctaaaaatttagcagtgtgatgcattgtggtcttaatagcaacatttttcattttgaactagatcttcccctttggttcaatggactttatttatgcatgggcgcctattgtttgttagcagttgtggaacagttgtgtatacattaaactgtgaaaatgtacacagttcagcctcagacggtggtaatattggttttattgggagatgtgtcacctcgaaaataccctttacatctgttgggatctgaaaatgagtcacattgaattgggttccagctttataatgagaaacgttattcctaatttttgagttagccaatttgcattccacaaattgggatcctcataacccaaatatatcaccgtatgtgagagggatttgaaagcgagtattgaaaaactcacctttgcatatttaatttccaccaaaaggagttattttggctttatgctcatgaacttagacctaactggccatgtatatgtagatgcaaattcatctagctgtggccctctttgatctctgcttgggaatggctatttttgactatgcgtggtttcttctcgtattttgtgatcaggtcagctcccagtagaaactcaaatggcatcaatattactaactcttctctgcccacttctcttttgtccactctcctagacattcccaccaactgttccagtgatttgggcaaaaatacgcagccatttcccaaaacttcacatgtgcagctatcatggctgtccctccctagacttggaggtgactctcacttaatttttacctgcccaacaatgttccatctaccatctaaaaggtaatataagaagaagttttgaaacccactttaggaaaaccatcttctttaaatccttcaattatctgaggcctctatatgtcaaaactatttttcagttgcaggggattgggcaaacttgttctttcttatacttgggttcaaagacccattctccagtttcatatttcccaaaccaaaatgcttgacataaagccaaatcaactgccaagcacactttattttgcataggagtatgcagcctagggaaccttggttgaaaagcagcagtctgctatgcaaaatattggaaatcactgacagtgtagcattcatattatctgtcaatgagggtatattgggaacgtgctctcgtgaataataaaaagcaacatatttttatttggccttataaattaggttgtggtaatgtaaactttgatatatagtctttttatttttctcttattaatctgccaaagatgggaacagatacaagaatttttcaaattggcttttgtaagacaattgatgattgtaatagtgtttaatcttccagaaagctttatatgttgttccacaataaaattgatatttgtttcagcaaagttttcctgacactcacaaacccacaaactgttcctcttaatgcagatattgtagaatctacaaagttcaaatccatttttgatccaaagaaagtagaggagtatttgagacatgagtgtacccagccctttttttaatcacaggcaatgcatgggtctggctggttacactttgccaagaagacttgtcttatgaaacccaaggtatattttgttatgccattttatgtccttttcttttaacattgtggaaagtggtatgttgaatcaagtgtaagctgagttttccagacaactgaagtagctacatcatgaatgttattttgttattaaagggtttttactcagtgctttgtgccaatggatgtccttttccttggagacacataactacaaaattacctcagcttggcctggttttctctcctgccctcttggggaaacatgggcctggcctgggaaaaggcaggtcatgggctggaaggtaggttttggtactaggaagaaatctctgtatctgtcagctttaaagagaactgggccaaaaatctctaacctcactctctctggactccaacacttccctgcaatcctttggtcttgagcatgtgccagcatgaaggcagactccagttcatacatgaaaggcaagaaaaagaaaatagtaaccttgaatcttctgtgggccaccaggcactcacctttccccaccttgcacactatccagtcaaggctattgcagcccatctggtggctttacatgggacattaccaaaggcttcttcctccatcctggggttgcaaaggatccaggtcccctccatccagtggggctcttccacatcagaagtccccctcccaccatcctctgcatcctgtttagctatcccatctataccttttggagatgattatttagaaaacaaagaaaggtatggaatggggtttcctattgtttgctaggttatattttagcaattctcaattctttgatctggaaaaatacaagagggaaaaggagaccccactatctccctgtgctttgctcccatctcagggggcaggggcagtgcacattgcctatgctgttgatctgtcttgggcgacaggctgaatcacagctattgccccagccaaaaacatggcccatcaatgcctactttatctctgcttgaaaatcctattcaaaaagttgtagagtttgaggtttttatccccccatatcctttgctttggtccagtttggcctttagcataagagtcagctttatctctaggaaagttttttcagattatgacaaggaacctgccacctgggaagaaaagagtccgaagactagcaatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagggaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaccctggcctcagatgtgtttattcttgctatttaaaaatacctttaaatttcacatgctggcctgcagaacttgcatcctttgttctatactgttgactgcttgatggtattgaaaggtgactataatgagggaagaaaggaggaggtaaagagagaagaatttgtcccagatctgtttaaagtttcaaaatttaaaaagggacccattaaattatgggaaaatggctatagagtgtgagcctccgttgaccatatgctcaaagaccgtactctgccacctgccttccaggtagctattctagaaactcagtcctttgtggaaacccaactaccttttaaaagtctctttccagattccaaaaggacaagagatcagagagtcacatatacgcctcttgttttattttcttgctttcacgggtattattgccaagaaaatcgtagggaaaaactttaaacttttcttttcagttgatccctttgacatcacctctcatgtttaaaatcaggaaaacacacccctaaaatttgcactctcttccgttttgaaaaagaaaacccacacacaaatgcacactattaccgtctttcaccctgcgctatatttccaaagtgtattataatccagatattgccccatctcaaacatgttaagtcagactgtgctgaaagactttccagggacggtcaacagggtatatgttcagtggctgccctgaaatcctggtggggatgaggatcacgcttcatcatcaaggggatgcccatcccctgataagctcccagtccttttggaagatttctttgaatgttaattgcattttcagttttgctcatttcccaccccaatgttttgtctgcaacatcgcttacactggattctttctatttttattcctatcattaaatggtagtgctgtaaattctgcaattaatgttaaataaactgctttaattcattg

SEQ ID NO: 162577 - DNA, 8318 bp, Homo sapiens
  Payload ID: 12027
  Gene Symbol: ONECUT3
  Gene Name: one cut homeobox 3
  Uniprot ID: O60422
  ENST ID: ENST00000382349
  CDS Start-End: 1291-2775
caagcgttaccccgggggtggggggggcagaggcaacggggaagcaggaaggggctgaggctggttttggactctgcaccgtagcctctggcctacaagacagagcatcctctagattctggtctggcccctccagatccgcagccctgaccttaccccactggcgggatctagtcccctgggggtctctctgattataggagcccttcccccatctatcccagttcccaggggcccctggggctcacctgtctccaggtgctgagaaaaaggagacccctgcctccccccacattgaagagaagccccagggacaaagaggagtttgcaccagcgacgtctcagaagacaggggatccagcctcagcctccgtgggctggagggtgacaggggctcttagtggtcacccccaggctccagtgcctccagcggccgcactgtaaaaaggccctgcaattagaaggggcctttggcaaccccgaggccgggcagcccattgtacagttggggaaacggaggcccaggtgcccacacatgggcagaggctgacccctggggcgcacggaggccctgacctagccttaggacctcccttttcccccacttcctccacaaagaggttgtgggaagggggctgtgactccgtaggtgtgagtgggagtcgggggaagctgagcttgcagtggggatctagctcctgggggtctgtagggaacggggggggggggggacacgtacattacaggcgaccgtccagccacactcccagaaactccctggagatggacttgggggtgccaggcagaaagccacatctgggactctggagagaatcacacagagacgcgaaatcggagactctgggtcgaggcccccagccccacctgggcagagtctgtcctcggacccccgcccgctgtcccccgggtacggcctgccccagcgggcgcgggcgggcgcagtggccagggacgccgaagccccaagtctggccgacttcggcctgcttggtgctcgagtggggccggggcgggcggagagcgaggctgcgggaggcagcggtggcaggagcgggtgggcgggggcgctgacgtcagacccgggcccgggcgccggcggccgctcccctgccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctcatgcgcgacgagcgggcggcgctcgcctccgtgggccacctctacggaccctacggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcagcctgcaagcgcaaggaacaggagcagcagaaggagcgcgccctgcagcccaagaagcagcgcctggtgttcaccgacctgcagcgacgcacgctgatcgccatcttcaaggagaacaagcggccgtccaaggagatgcaggtcaccatctcgcagcagctcggcttggagctcaacaccgtcagcaacttcttcatgaacgcgcggcgccgctgcatgaaccgctgggctgaggagcccagcacggcccccgggggccccgccggcgccacggccactttctccaaggcctgaggcgccccggccccgcgccctccctgcctccacggcctgggcgctgtgcccccacgtcacctccccacatcctgccggcccggagacccgcccccagggggcacctggagggggtgctatccgggccccccacacccggggagggggaagcagcacaccccccagcccaagtgcacaaaaagggccccccttcctccctccatgcccactccctccaggccaaaggaagccctccacccccccccggaggggagggagtgacagaaaggggtttcccagccccctctccattcaggacgcccagagggcctcgagaaaaaccagggctcactgtgttgtcccctaaagcgggtcaagaagcacatactagaaatataaaccgggtatttaaaaatggaattttaaagaataacccctcctccgtcagatcccctgccccaccgagggaggtagtagaaaacttccttcctccccacccgccccggccccctccccagggacctcagccctttccaaagtcgccaaaaacccacatcaagccggatccttacggtcccccaccctctccaaaaccaaccccacccgctggcaggacggcccctgcggccgagaactgagctgcccctctctgcggccaggattcctcgtgccaagaatcgcctgccttaaagtctggggaggggcctgcggcgggcgcccagcacctacgggcgagcacccttcccaccccatcccaggccgcaggggacggggggctcccacgtgcgggtaaattccagacgcccccgccccgccccgtctgttgagttcactttacctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttccactctcgccaaagagagaagacgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagcccgcctcctccgggggttcaagatccgagtctagaaggaacctcctccctgaaatccccccactcatcggctgcctcccagggaggaggcggcccccctaccccccttgaaaatgcaaaagacatttctagtgaaatgcccctcccctcccccaggtaaaggctacctcactcaagctcatgtctgtgattggaaaatcacgcctgataccaaagatttctcccaaggatttgtgctggatgacaggattccctggcctgggacccggctcggggccccgcctgccgagtgccaccccttcccgaacctgagagcgaaagagagagagagagagagggagagagagggagagaaagggagagagggagggagaggatcgtgaggtcgaagagtgccttcttcttgaaccaaagacgtgtatggagtgttctcttgtccttatcgacttgctctgctcccagctttccaagcgaccggatctgagtgatgcttctagaacatttgggtgttggggggttcccaatagtagaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatacacatgcacacacacatacacacactggcccctgtttttctgtggtgtcactgggtgccagcaactcggtatctcccacctcccactaaaacctgggccttaatttctctcccgtccccacccctaaattcctgatggatgaacctagagctgtcctgtccactccaggccggactgacgtagcctatgggcccagcaggtccagggcccacgttttaatttctttttaaaaagctttaggtcttgccgggcgcggtggttcacgcctggaatcccagcattttgggaggccgaggcgggtggatcacaaggtcagcagttcaagaccagcctgaccaacatggtgaaaccctgtctctactaaaaatacaaaaaaattagctgggcgaggtggcaggcacctgtaatcccagccacctgggaggctgaggcaggagaatctcttgaaactggaaggcagaggttgcagtgagccgagattgcgccactacactctagcctgggcaacgagagcaaaactccctctcaaaaaaaaaaaaaaaaaaaaaaactttaggtccaagaagatgcaccccattcaacataccatattatttgtctttataccaaggtagcctatagatatacaatgttttaaatttcttttttagaaacagggttttgctctgttacccaggctggagtgcagtggtgcaatcgtagctcactgcagcctcgaccacctgggctcaagtgatcctcctgcctcagcctcccagtagctggggccacaagcacaccccaccatgcccatttaattttttaagggatttcttgtagatatggggtctcactatgctgcccaggctggtcttgaactcctggccccaagggggtcctcctgcctcggcctccaaaagtgctaggattacaggtagatagacatttagtggaggaagaggctctcaaaggcaataaaatgcttctgatccaagagaatcacgctgcagccctggcccagtgagcttcttagaaaatcgatgcctgggcttcaggcactggccggagcacgggcctggcggggtgctgggtctcctagatgccctctgcttggccttcaaggccccaagggtaacacgctagggggcctccagttttgtcccctgctggaaatttaggacttggcttgggatcgttctggttgtggaatgttttagctatgctgaactgtggtcagatcaggtcaagcctcttggtcacagaagtggcccagcagcactttgggaggccgagacaggaggatcgcttgaggccaggagtttgagaccagcctgggcaacacagcaagaccccacttctacaaaaaaaaataaataaagtggcccaggactcctggatccttttcagatatcttcgtatcacacacacacacacacacacacacacacacacacacacacacacacccctacctgtttccggaccccaccccaaacttggccagacccccacagaaggctctatccccgacctgcccgccggcccctcaggccctctcctgcctccccgcatgcccacttggctgtcacataccaaagagcatgcgttctccatgcagggatcaacacctccagcacaattccttcgagcctttgacaattttctctgaaatacctcaaaatatttaatgtatagtttatgtgattaaaaaaaaatccttagctagtttttggaatacgtgacttgaagctttataccgttaaattataattttgcagacgatggcatgtcgtttctttgacgagttccgtgggagacgcattgaatgtcagggctggagaccagagggaaagttagagggagcgtgatcgcgagagagactgcggcagaaaggaccagtggcgtttacagatttcttatttaaatgagtcctttaggaaagaaaggaagagagagagagagcgagcgcaagagagagagagagggagagagagggagagggagagagagaggcagaggtatacctttctgttctctggcttgttctgtttcttgttttctggagtcatgtcttataagagtatttattattctctgtgttctgtgttcaaatgtaatttaagaaaaaaaaaggaagaaaaatgcaaaaaaaaaagacaaaatggaatttgagttggtgcatgactaatgtactctttcttgacgctaattgtaataaagtggtcagggtggggggcggggggcgtggcccggttccgtgtcgcatctgtgtgtctggtgcctgatcggtgctgttcagtggtttttcgttactgtttctttcctcctttctaaggaactgtgtccagccgggacaggtggacggggccccaggtagagggggcgggaacagagcctcagtagccgggtctcctccacctgcctgtccatctccacccgagatgccacctgcctgccccagccaggcgggagccaccgagcgtccccccctcagttcctggttcttgggggcactctggtgtcatcgatatcttagacccccccaaccccccatcacccggttgctttcactctagcatgaattcccaagtgtcttgttcagaggagacagacaatcagcctattcttgtcttgttgcccagggtggtgggggacgggagtgtgccccaacttcctgagatctgaaggaccctcctgagggccccaacagcaggcaccagcaccccctccccccccacctccacccagacagcctcggcctccctccctgggctgggcatgagtccgcctttctgtccagcccgggaggcagggggtgtacgcctgcagagacccctccctcccagcccactttcggagcctacagaacagaggactccccaaaatcatcaaagggggctctgggacaatgtcctctgcctctgactcctcttgtgccatgaggccacgtccctgagccatccccagatagtccctggaggtggaaaggggcacagatgtgccagcttgggaacagaggctggaggagagggcggcaggggagagatgagaggggccgcttttgggacaggccccagtaggggggggcggggtagctaaacggggtgcttctcaccccataaagcagcaagccctggtctggagggctgggcctggggctgagggctcagctgacctcaaatctgaaatgatgccggggccaggatgctccttgcaccagcaggagcttgggccatttcacattctctgccccaagcggtttaagcaaaatcaggccagtagactcctggggctcctcctcgtggccctgtcagaccacgcaggggctggttttggtggaatgagctcagccgggggtgacggaagagccaggaggccctgcggccttgagtgttttgaatagactggaactgagggctgctttcaggggagacaccacttggaccctccaaagtcccctcccctccagggacaggggagagaagcccttttccaccttcacccttgggcgacaggcttaaaagctaaaaaaaaaaaaaaa

SEQ ID NO: 162578 - DNA, 478 bp, Homo sapiens
  Payload ID: 12028
  Gene Symbol: OOEP
  Gene Name: oocyte expressed protein
  Uniprot ID: A6NGQ2
  ENST ID: ENST00000370359
  CDS Start-End: 1-450
atggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctggcagacgagctctttggcccagaccgagccataattccagaaatggagtggacgagccaggccctgctgacagtggacatagtggactcagggaacctagtcgaaatcaccgttttcgggcggccccgtgtacagaatcgggtgaagagcatgctcctgtgcctggcatggtttcaccgagaacatcgtgcccgagctgagaagatgaaacaccttgagaagaacttgaaggcccatgcatcagacccccactctccccaggatcctgttgcttaagacaacatagttactgttgggaacatct

SEQ ID NO: 162579 - DNA, 1007 bp, Homo sapiens
  Payload ID: 12028
  Gene Symbol: OOEP
  Gene Name: oocyte expressed protein
  ENST ID: ENST00000370363
  CDS Start-End: 494-778
gcggccacggcctccgggggcctagaggtgcctctccagcgaccacctctgccgacactatatccctcaggacctgttcgattcaactcctccgccggcctcctctctggcgctcgggacactgtcgagcttcgccgactagcaacgacccacgtagaggccttgggagctcctccgtggtgggacattgttccaagaaggggcgcgtccgacgtcgttgccgtccagctctgcaccacctgaccgtgacgtcgtaagagtagcgtgccagggaagccacgcagccgctacttaaggagcccgcacgaggctagcccccccgcccacgctctctatcccgcccacttcgcactgatttcacgcagccattggccaagacggggtgtcgccgtgttgcccaggcaggtcttgaactcttggcttctggcttcaagtgatcttccagcctcggcctcccaaagtgctgggattacagtcagccactgcaccggaaatgttttcaaccgtgacccataaaggcccagaccgagccataattccagaaatggagtggacgagccaggccctgctgacagtggacatagtggactcagggaacctagtcgaaatcaccgttttcgggcggccccgtgtacagaatcgggtgaagagcatgctcctgtgcctggcatggtttcaccgagaacatcgtgcccgagctgagaagatgaaacaccttgagaagaacttgaaggcccatgcatcagacccccactctccccaggatcctgttgcttaagacaacatagttactgttgggaacatcttaactttctaacttttgctgctaaagttgaagaaaagcaagtatagcattcttaaatccccgtattcctttttcctgtgtcttgatggattgtggtttattttgttgcaagagtgagtttgaactattctaataaagaaatggctattttgccaaaagcattaagatcttcacacacttataataaagcaaatttataaaa

SEQ ID NO: 162580 - DNA, 964 bp, Homo sapiens
  Payload ID: 12028
  Gene Symbol: OOEP
  Gene Name: oocyte expressed protein
  ENST ID: ENST00000441145
  CDS Start-End: 764-964
gctcttcaaagcaaaacacagcggcagttcctcgtgaccagcggccacggcctccgggggcctagaggtgcctctccagcgaccacctctgccgacactatatccctcaggacctgttcgattcaactcctccgccggcctcctctctggcgctcgggacactgtcgagcttcgccgactagcaacgacccacgtagaggccttgggagctcctccgtggtgggacattgttccaagaaggggcgcgtccgacgtcgttgccgtccagctctgcaccacctgaccgtgacgtcgtaagagtagcgtgccagggaagccacgcagccgctacttaaggagcccgcacgaggctagcccccccgcccacgctctctatcccgcccacttcgcactgatttcacgcagccattggccagtgagcgttgtgggcgggactttcccagttttagccaatcggttttctgaaccgtgggagtgtgccttgaagtagtcgatgtgccccgccccccacccccccactgtgtattcctttccaggcgtgggactttttccaaacgcccaatttgctccctcccctactggacacacacctcgggttcctggcatctcagtgccttggaaacttttttttttctttttaaatagagacggggtgtcgccgtgttgcccaggcaggtcttgaactcttggcttctggcttcaagtgatcttccagcctcggcctcccaaagtgctgggattacagtcagccactgcaccggaaatgttttcaaccgtgacccataaaggcccagaccgagccataattccagaaatggagtggacgagccaggccctgctgacagtggacatagtggactcagggaacctagtcgaaatcaccgttttcgggcggccccgtgtacagaatcgggtgaagagcatgctcctgtgcctggcatggtttcaccgagaacatcgtgcc

SEQ ID NO: 162581 - DNA, 1633 bp, Homo sapiens
  Payload ID: 12029
  Gene Symbol: OOSP2
  Gene Name: oocyte secreted protein 2
  Uniprot ID: Q86WS3
  ENST ID: ENST00000278855
  CDS Start-End: 186-662
aatcaagagagtctcagcctttaggtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtttctaaaaaccctacttcagtaaaggtcctgattagttgattagtgaatgtgtatttctaaatatttgtattcagtaggggtatggctgattaatttaacattaactattaggtaattcatattatacatttaagttctttctgttctgtgtagaagattcagaaatatgtcttcaaagacaatgacttgatctaattgataagaacctccaataaatatgttctaatatttttcaggaagaataaagaatagagagagacatataaatgtgcaagaggcaaaactttgagcatagtgtaaaatttaacatattaactctcacgaaaggcaaaatccttttatgtgcagatactttaattcatgtagattttcctattaatcagtaaagttgaatcctaacaataatgccatgtgacaacctatttagattattccagaattaaattcaatttattttctagagctcaagtaaccactaccttaactgaaatttgatgttaggtttcccttgttcctccgaatggttcttccacactcaaaataattgaatggttgagttggttaagcaaagagttatcctgccacctaagagcattcattaaatgattatttattaccacctactttatactatcttcctttctttaaacatggagtctaaatatgtaatatatcaaaaaatacttctgatttggtagatttcttatatcaagggtgagaattgaactgtgccattggctattcaatagcttattgaatgtatgttttggatgccacatcctcctggaagcaaattttgccaagatactgtttattattatttttaattaaagtgatactattccattttcaattaaa

SEQ ID NO: 162582 - DNA, 496 bp, Homo sapiens
  Payload ID: 12029
  Gene Symbol: OOSP2
  Gene Name: oocyte secreted protein 2
  ENST ID: ENST00000532905
  CDS Start-End: 65-325
tgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctagtgtttgatgcagaaatcatggggagactatctggaattagttcttctgtaagcctatctgctcaaatcctgtaccaagagtccacgaggatctagaaggcatagtatgctggctctatgccatactcctgaatgactattctgtatatgatcatgatattaaacagtggtaaaactga

SEQ ID NO: 162583 - DNA, 1236 bp, Homo sapiens
  Payload ID: 12030
  Gene Symbol: OIP5
  Gene Name: Opa interacting protein 5
  Uniprot ID: O43482
  ENST ID: ENST00000220514
  CDS Start-End: 61-750
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagagttacaaataacgtcgttttggaagcgcccttcctagttggcattgaaggttcactcaaaggcagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatatacaa

SEQ ID NO: 162584 - DNA, 485 bp, Homo sapiens
  Payload ID: 12030
  Gene Symbol: OIP5
  Gene Name: Opa interacting protein 5
  ENST ID: ENST00000560640
  CDS Start-End: 1-485
gagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagagttacaaataacgtcgttttggaagcgcccttcctagttggcattgaaggttcactcaaaggcagctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccag

SEQ ID NO: 162585 - DNA, 3369 bp, Homo sapiens
  Payload ID: 12031
  Gene Symbol: OPRL1
  Gene Name: opiate receptor-like 1
  Uniprot ID: P41146
  ENST ID: ENST00000349451
  CDS Start-End: 413-1525
cgaccaggtggggcgggtcgtggcggggggcagggtcccctccggagggccctgggttagagtctgggcgtggacgcgcccctcataggggtcattggggcatagaggcatagagccggcttctccagcttgggattcacgtgtttttcaagggctaacggaaatgctgagatctaaaagcatgtttattgctgccaaggcctgacgatgaaacttcaagtcaaattacttcgggctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaa

SEQ ID NO: 162586 - DNA, 3321 bp, Homo sapiens
  Payload ID: 12031
  Gene Symbol: OPRL1
  Gene Name: opiate receptor-like 1
  Uniprot ID: P41146
  ENST ID: ENST00000336866
  CDS Start-End: 365-1477
acggagccgcacggtagtagatgggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcggcttcgggctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaa

SEQ ID NO: 162587 - DNA, 3147 bp, Homo sapiens
  Payload ID: 12031
  Gene Symbol: OPRL1
  Gene Name: opiate receptor-like 1
  Uniprot ID: P41146
  ENST ID: ENST00000355631
  CDS Start-End: 191-1303
ggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcgggtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaa

SEQ ID NO: 162588 - DNA, 2191 bp, Homo sapiens
  Payload ID: 12031
  Gene Symbol: OPRL1
  Gene Name: opiate receptor-like 1
  ENST ID: ENST00000615600
  CDS Start-End: 1-880
gcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttg

SEQ ID NO: 162589 - DNA, 2724 bp, Homo sapiens
  Payload ID: 12031
  Gene Symbol: OPRL1
  Gene Name: opiate receptor-like 1
  ENST ID: ENST00000627060
  CDS Start-End: 1-880
gcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaa

SEQ ID NO: 162590 - DNA, 2724 bp, Homo sapiens; identical to SEQ ID NO: 162589
  Payload ID: 12031
  Gene Symbol: OPRL1
  Gene Name: opiate receptor-like 1
  ENST ID: ENST00000625570
  CDS Start-End: 1-880

SEQ ID NO: 162591 - DNA, 6833 bp, Homo sapiens
  Payload ID: 12032
  Gene Symbol: OPCML
  Gene Name: opioid binding protein/cell adhesion molecule-like
  Uniprot ID: Q14982
  ENST ID: ENST00000331898
  CDS Start-End: 580-1617
cccgccttggaactttttgccgccttggggttccagatgcgagacctggggctgggggacacgtacatctgtccatgtgtgtgatctaataaaccatttcctcctctccttgaagccgcagctttttatgacagctcctgtatgtcagagacacttgccttcttctttgggttataaacttttgatgccagagctctgcagaacgtgcccaactgaatcttaaagtagcgtctcgaagagagaggcagagaaagcgcaatctgtgaccttcatccccgcaccttgcttcttcctctcccctcctggccgcctccctcctccccaggggagcgtcaagaaagctctttttggatgcaggagggggcatctggttctgctaggctggaaagctgaggcaggatctgaggaagaattctcagactccggagagcccggactcctctcttctccttccccctgctcctggcgaactctgccccttccctcctccccgcaccgcttcccgagcccgctggtgcgcggggcgggggaccaggactgtgcggctgccggagtcctgggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttcagatctgtcaccaccttcagcatctggagttgagttggtgtcagatagtgtatgagaattaaatgtgtcatctgagcatgctactgatgataaatttgttactttggagttgaataaatgtgaaggctgtgaagagtggacagtcttggagaacacagtgcttgaaatggacaagctggacctattcctcactccaagacttgttctacaggaaagggtccatgctcctttggccaagatcatcagaacctctcaacccaacaaggctggcttcagggccactatggaaccctgctgttcccccttccaaaggatactaagatgcccctctggtgggtacctatcccagccacgtttcagagggagagaaatgctacagttgatcctcatctgtctggggtaaagacaacaaagtaaatacaacccaaggcaactggggtactcactgggagtgaaaatgacttcttcacaacagacatatttctgcttctgtgtttttgtgtttctttggtggggatggcttcatgggagagtggctgtcacccatcattttgaagcatatagaacaacaaatgcttacacaagacaatatccacacttttccaacttcacacacggagagtacatggagaatgcctacaggctagatttgttcagggtgccagtagtgggcatggggtgggggcaaggcaggacaaaacatacaagtctgagcaagtacatctcttgcaggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagccaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttagagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctcgaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaacttt

SEQ ID NO: 162592 - DNA, 1302 bp, Homo sapiens
  Payload ID: 12032
  Gene Symbol: OPCML
  Gene Name: opioid binding protein/cell adhesion molecule-like
  Uniprot ID: Q14982
  ENST ID: ENST00000374778
  CDS Start-End: 215-1129
gcgccgggcggcgctcccccggctggccgcgagtcgccgaccgggctgcagaggacggccaccgaccggacgaccctggctgcgccggctgcgcgtccccgccttggaactttttgccgccttggggttccagatgcgagacctggggctgggggacacgtacatctgtccatgagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatg

SEQ ID NO: 162593 - DNA, 6424 bp, Homo sapiens
  Payload ID: 12032
  Gene Symbol: OPCML
  Gene Name: opioid binding protein/cell adhesion molecule-like
  Uniprot ID: Q14982
  ENST ID: ENST00000524381
  CDS Start-End: 196-1212
tgtgcaagaaaagaaatcagagacgctgcctgcctgctcccatctctcgcgcgctctctctctcttctgctctctccctccctttgcaaacattggatttaaacctgctcagaattcagcacagaggaaggcagcagcggtagcagcagcagaagcagtagcaagcccggcagctgagagcaccgcagcgtcgagatgtaccatcctgcctactgggtcgtcttctcggcgacaactgccctgctcttcatcccaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttcagatctgtcaccaccttcagcatctggagttgagttggtgtcagatagtgtatgagaattaaatgtgtcatctgagcatgctactgatgataaatttgttactttggagttgaataaatgtgaaggctgtgaagagtggacagtcttggagaacacagtgcttgaaatggacaagctggacctattcctcactccaagacttgttctacaggaaagggtccatgctcctttggccaagatcatcagaacctctcaacccaacaaggctggcttcagggccactatggaaccctgctgttcccccttccaaaggatactaagatgcccctctggtgggtacctatcccagccacgtttcagagggagagaaatgctacagttgatcctcatctgtctggggtaaagacaacaaagtaaatacaacccaaggcaactggggtactcactgggagtgaaaatgacttcttcacaacagacatatttctgcttctgtgtttttgtgtttctttggtggggatggcttcatgggagagtggctgtcacccatcattttgaagcatatagaacaacaaatgcttacacaagacaatatccacacttttccaacttcacacacggagagtacatggagaatgcctacaggctagatttgttcagggtgccagtagtgggcatggggtgggggcaaggcaggacaaaacatacaagtctgagcaagtacatctcttgcaggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagccaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttagagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctcgaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaa

SEQ ID NO: 162594 - DNA, 6277 bp, Homo sapiens
  Payload ID: 12032
  Gene Symbol: OPCML
  Gene Name: opioid binding protein/cell adhesion molecule-like
  Uniprot ID: Q14982
  ENST ID: ENST00000541867
  CDS Start-End: 1-1065
atgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccacccttaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgaaataagcccctcatcagcagtggcagggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttcagatctgtcaccaccttcagcatctggagttgagttggtgtcagatagtgtatgagaattaaatgtgtcatctgagcatgctactgatgataaatttgttactttggagttgaataaatgtgaaggctgtgaagagtggacagtcttggagaacacagtgcttgaaatggacaagctggacctattcctcactccaagacttgttctacaggaaagggtccatgctcctttggccaagatcatcagaacctctcaacccaacaaggctggcttcagggccactatggaaccctgctgttcccccttccaaaggatactaagatgcccctctggtgggtacctatcccagccacgtttcagagggagagaaatgctacagttgatcctcatctgtctggggtaaagacaacaaagtaaatacaacccaaggcaactggggtactcactgggagtgaaaatgacttcttcacaacagacatatttctgcttctgtgtttttgtgtttctttggtggggatggcttcatgggagagtggctgtcacccatcattttgaagcatatagaacaacaaatgcttacacaagacaatatccacacttttccaacttcacacacggagagtacatggagaatgcctacaggctagatttgttcagggtgccagtagtgggcatggggtgggggcaaggcaggacaaaacatacaagtctgagcaagtacatctcttgcaggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagccaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttagagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctcgaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaa

SEQ ID NO: 162595 - DNA, 6250 bp, Homo sapiens
  Payload ID: 12032
  Gene Symbol: OPCML
  Gene Name: opioid binding protein/cell adhesion molecule-like
  Uniprot ID: Q14982
  ENST ID: ENST00000612177
  CDS Start-End: 1-1038
atgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccacccttaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttcagatctgtcaccaccttcagcatctggagttgagttggtgtcagatagtgtatgagaattaaatgtgtcatctgagcatgctactgatgataaatttgttactttggagttgaataaatgtgaaggctgtgaagagtggacagtcttggagaacacagtgcttgaaatggacaagctggacctattcctcactccaagacttgttctacaggaaagggtccatgctcctttggccaagatcatcagaacctctcaacccaacaaggctggcttcagggccactatggaaccctgctgttcccccttccaaaggatactaagatgcccctctggtgggtacctatcccagccacgtttcagagggagagaaatgctacagttgatcctcatctgtctggggtaaagacaacaaagtaaatacaacccaaggcaactggggtactcactgggagtgaaaatgacttcttcacaacagacatatttctgcttctgtgtttttgtgtttctttggtggggatggcttcatgggagagtggctgtcacccatcattttgaagcatatagaacaacaaatgcttacacaagacaatatccacacttttccaacttcacacacggagagtacatggagaatgcctacaggctagatttgttcagggtgccagtagtgggcatggggtgggggcaaggcaggacaaaacatacaagtctgagcaagtacatctcttgcaggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagccaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttagagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctcgaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaa

SEQ ID NO: 162596 - DNA, 2410 bp, Homo sapiens
  Payload ID: 12033
  Gene Symbol: OGFR
  Gene Name: opioid growth factor receptor
  Uniprot ID: Q9NZT2
  ENST ID: ENST00000290291
  CDS Start-End: 26-2059
agcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 162597 - DNA, 4506 bp, Homo sapiens
  Payload ID: 12033
  Gene Symbol: OGFR
  Gene Name: opioid growth factor receptor
  ENST ID: ENST00000370461
  CDS Start-End: 2278-4155
actggagttcctcaggccgctctcctgaagcggtgctcagaggccctgaccatcctgccaggcgcccgtgacccctgacctcttccctctgcctcctgctgtggcttctgtccacaagcccctccccttcccctttggacccctcaggcctccccagctgcctgcgctggaccctggcggggctgtttcactttttcctgggcagtgtcatgtatgcacctgtgggctgactgtgtggccacatccagtcaggacccagcctccagaactgacccagggaggctcccgctggccccaggaaggagaagtagaaactgatgatcaggcggggcgagagaaccacaccagcggccctgttgagaaatcaggccgagaggtcggtggcggtggctcaggcctgtaatcccagcactttcggaggcctgggcagtcggatcaccagaggtcaggagtccaagattagcctggccaacatggtgaaactgttgtctctactaaaaatacaacattagccaggcgtgatgggcacctgtaatcccagttcctccagagattgaagcaggagaatcgcttaaacctgggaggtggaggttgcagtgagtggagattgcctgggaggtggaggttgcagtgagtggagattgcctgggaggtggagattgcatgaagctccatctcgaggggaaaaaaataagaaagaaaaatcaggcagagaggcaacgccaggtcccagctggagctcagcggggagccaggggatacagtggctgaccgggcctcctaaccccccttctagcactcccccaggatcctgggtcccaattgttgccctggacaaatacgcccattcctgccctacccaccgagtgaggctcagccccaggccccccaccctcatcacaaggtcagggctgtgtcccaccatcctcatcactaggtacttccggccctttgctcagccccatgatgcttggcctgcagagatgggggctgaagggcttggggcatcaaggggacctgacatcttgctgagaagccatcactagacagggctggaggctggagactcagggcctgccctcaccgtggccagtgaggcgtggggttgggcagggaaggggcattcattcattagaccctgccagaagcacctgggtccccttctggggctacaggtggtgaggccactgcccccaagaacacagcctggtgactttagtgtacaaagcagggggagtctccaggggcacagaacagaggctaaagccagggtggaggtggccagcaggcctaggaggaggagagggtcagggccacaccccaggggaggtgcatgtcagccaggggccaccctaaggtggaagccaggagtcccaaaggggcctagagaaggagcagccccccacctggctaccgcagccctctctggttctgtgcagggtattgggatgcgttactgaggcccaaatctgccccactgggaacccccaaaaaagagccagggcaggagaatgagagggaggagccatgaaacccccgccctttaaagacagctctgtggcagctggcccaggccctgcagccctcaccacgttgggactcacttgggggtctcccatgggggtcctaatcccatctcttttcttcccagtccagaatgacagggtccagaaactggcgagccacgagggacatgtgtaggtatcggcacaactatccggtacgtacctgcccctgccccgggacacagaaccctcccgccagctgctcttctcaggcagaatgtcccaggttctactggaaggctggcctggcttgctgtgccagggccacagttctgggcaggaccctgcctggggcacagcctggtatagattcagagccctgcccttcccctctcgcgggagaccgggggcatccccctacttttctgagcttcagcacaccgtcgccttgcaaacatggccatagtgccagcctcgtgatgcacacgtgtggggtccgtgataccgcccacacagcaccccacccccatgccagccctgtctcctgcaggttgtcctcagccattaccctccacacccctgaatcacggaaacccctgtgctgccttcagggtgctgaggaggggacctgccaggcctggcctggctggcgaaatggggaaggggggtccctggggcttggaggcagctgctgtcctctgaatggcccccacctgcagagtgaggagccaggcgggctcttggggtattgggccagcctggaggtttgcagatgcgcctccccgaaagacacggagggccccagggcagcttgtgtctgatggatccctgctgtcccctttctctggctcttcaggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 162598 - DNA, 553 bp, Homo sapiens
  Payload ID: 12033
  Gene Symbol: OGFR
  Gene Name: opioid growth factor receptor
  ENST ID: ENST00000450048
  CDS Start-End: 271-553
agaaggagcagccccccacctggctaccgcagccctctctggttctgtgcagggtattgggatgcgttactgaggcccaaatctgccccactgggaacccccaaaaaagagccagggcaggagaatgagagggaggagccatgaaacccccgccctttaaagacagctctgtggcagctggcccaggccctgcagccctcaccacgttgggactcacttgggggtctcccatgggggtcctaatcccatctcttttcttcccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggagg

SEQ ID NO: 162599 - DNA, 1194 bp, Homo sapiens
  Payload ID: 12033
  Gene Symbol: OGFR
  Gene Name: opioid growth factor receptor
  ENST ID: ENST00000621591
  CDS Start-End: 8-1180
gccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggacctgcaggggacgagccagccgagagcccatcggagaccccaggccccagcccggcaggacctacaagggatgagccagccaaggcgggggaggcagaagcctccggcctggctgtgtcttcccacccagctctcccctgcgcccctgtctttgtaaatcccttctggagtggggggcggcgggcagggctgcttcttagtctgataccaagcaaggccttttctgaataaattcatttgacttt

SEQ ID NO: 162600 - DNA, 8391 bp, Homo sapiens
  Payload ID: 12034
  Gene Symbol: OGFRL1
  Gene Name: opioid growth factor receptor-like 1
  Uniprot ID: Q5TC84
  ENST ID: ENST00000370435
  CDS Start-End: 135-1490
gctgaggcagtgcggggcgggcgcgcctaggctgccgcccagcgccctcgccgcggccatgcccgggccctagagcgcctgccgcagcttgcgccccgcagccccgcagccccgcgcccgccgccgcctcttcaatgggcaacctgctcggcggggtcagcttccgcgagcccaccaccgtggaggactgcgactccacctggcagaccgactcggagcccgagcccgaagaaccagggccgggcggcggcagcgagggcccggggcaggagtccgagcagcccgcgcagcccccggagcaagccggcgggcggcccggcgccagccccgcgccggacgaggacgccgaggcggcgggcgccgagcagggtggtgattccactgaagcaactgccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgtaatgcttttaggatgtgaattttcaaattttgtatataataattactttgagaatattttcagagtatctagaaattaccatgtagtatttggtatacaaaatacattcttttgagacattatagtctacatgaaggaaatcaagaggataatttcattggattgctacacttttacctgatttatggctttattttactttattttattttattattattttttgagacggagtctctgttgcccaggctggagtgcagtggcatgatctcggctcactgcaacctctgcctcctggactcaaacgattctcctgcctcagcctcctgagtagctgggattacaggcgtgtgccaccacgcctggctaatttttgtatttttagtagagacggggtttcaccatgttggtcaggctggtctcaaactcctgacctcatgatccacccgcctcggcctcccaaagtgctgggattacaggcatgagccaccatgtctggctgattaattttttttttaactgtaagagtttgatcttttcaaatgtgttcagaaactaatttggattctttgattctagtatctcaacgtgtttatttttagattctgataagtgaaatggatgtccttgtggagctctggcctccccagcttatctatcagtcctgctgtcctcacctccttgcctctttccatgcttacccttaagccaccatctttctcagctagcgtgtgtgtttctagtgtagttggccctccatattcaggggtccagcatctgtggattcaaccaaccgcagattgaaaatatttgttggaaaaaatggatggttacatctctactaaatatgtgcagtccttttatttgtcattattctctaaacaatacagtataacaactattgacatagcatttatattgtatgtattaggtattgtaagtaatttagagatgatttaaagtattttacataagggacttgagcattcctagattttggtaactgcagagggtcctggaaccaaccccctacagatatcaagggaccactatacacattaggatgatctatattgaaatctacatggaacagagtgggacttctaattgtatgacttcaagattttgctttgtttaaattaataactgttttcagaattaagtgcttaaaaacaaatttgattgaaaagttcaagacaagaattttgctctctatggctgttccatataaatttgatggttgattctgaatgtaaatgactgaagaattaaaaaataagaaattcctttttaaaaggcatgcctcttgcactgtgaacaagacagtagtcccttaaaccatgaatatgtcagtgttctatggattacgaaattagtaatgttgcttagcccaaacgtgttttttaaaaagtatagttttgtacatctctaagttatcaaacttcaaaattgagaacaaatttaaaagtccatatatgcaactctagtaagcacttaataggttacatagcactggttaagaacaattaattttgtttctatattattactaattattattacaaatcaaaaaacactgtgataagaacttcaaagcatatatacaaatatagttaaagcaatgaatagatgaaacatgtctactttatttcatttagaaaggaattaacttttttgttaggcttttaagaaaagttctattcattttaatcccctagggaatttgtaatatgtcctacttcatatcatcttctgttgcctctattgatccacattttctgcagtggatttcttgaaaagaatcacacttatagtatgcctctagaaatatgattttactgctttgaagtttacatgaaacatgccagttgcttaactctaattttttatatgaatctcagtagcacttttgttgtacattgtgttccaataagtatagtatggaacactttctcatttttagttcccataatatgccagtttttgctttcctagtgttctgtgagtattaggatttggcaatctgcttttgcatttcaatttctgttttacatgcaagaaaaacatggacactcttacgtggtgcttgtagctgtgtctccgtagagctcagtaaatagttctacagggtttagaggatgagaagcgattgtcaaattaggctgaattgtagaacacaaataatttaattcaaaataacttaccaattttatatacatgataaagtattcagacaactttctaaatgcataatagtaaaagattgtgaccagatattatgatattaataaagttaccagatactaaaatcaatgaatgtaatttgaattacttagaaattgtatattagagcccttatgagtaaaaacatttcatttagcaacttaacttttagaatattcttcctacttagggattttgattagattgtaacattaaattcgagaatatttagtctcaagagaaacacttcctggcatccatcttaaatagtggccttttcccactatggtgtttttaaatgcatattcatatataatagtatgtttcttacatttaatccctaaataacttagataatcattcagtggagaacaagtaaaaggatatcattccttttggagataaacattgagtgtctagaatttttttctattaatgctttgtatattagttttttaaataagatctatagatatgtatttatgtgtgtcttatatatgaaacagtgctctgggtttgactcctatgttttgtaattttaaaaactacgatatgcttgcagaaattcattgagaagctgttataaaaaatgcagtgaagcatgaccaaatagctaaaaatattactgaatctttacaaatatataatctttattgttgtactgtggagtgcaaggatactaaatattggctattgataaaatactaacttgcatttcatggcaaatagatgttatatcgcttgattagtctagaacatttctaatattttgtgctttcatatatcaaaggagattatgtgaaactatttttaaatactgtaaagtgacatatagttataagatatatttctgtacagtagagaaagagtttataacatgaagaatattgtaccattatacattttcattctcgatctcataagaaattcaaaagaataatgatagaggtgaaaatatgtttactttctctaaatcaagcctagttgtcaactcaaaaattatgttgcatagttttattttgaatttaggttttgggactacttttttccagcttcaatgagaaaataaaatctacaactcaggagttactagagaagttctaagtatttttttgctaagtagtaaaaatataaacatatgaaaatgccataatgcctgtcatagtcattgtttcatattttgtcatataaaatcacctaccctgcttctagttttatactttaatctgagtgaaagtatgatgtggtggaaagaaaaaacagtacagtattacatctgagttagtctttgaaaaatcatagtagtaaatgaacctcaacactgagtggtcaaaaattgggttaaccaatggggggagaatatttggttaattgttttaatattaaattttcaagtttataatagagttatggttgagtagtcatccatactgagtaatcacgcattttttaaactataattgaggctcttctaaagctttgttttctaatctaagatacaaaggatattcttgatcttgcttgattgtaactacatctaccagtctttaatgtctgtttggggtgagtggcgatcctctgttgtaggaatgtttttgaagatttctattttgttttccacttaggaaattcccctctctcatttggggtatatgcgttgagtataaggtaggctgtatttagacacactagaatcattaaatgtaggtgaagttgtagagaaaaatggcctgggtcaatgtaggatctagaaaattaggagtgtacatttgctggcttctttttgagttttgtactgtttattacaggaacatatttgtgtggctaatctctagggtgacagtgagtactaccctgctccttctgcattctagttatccaacacacccagcagattgtgttcagggacagaatgtgtttttagaaatcccttattattgaaatgaataataatatagctataaatatgaatgtctggaggtatccagatgtgccttaacaaatgtaaatggttttcattcagaagtttacatttttattacattataaaatctcatcattgggaactttctaaaccatgaatatcagttcttttaatgaaatttaggtggtgctttatcattttggagaagttgctgtttgggacaatagcatcagtttatcaagaagtgtactcaccatgatattcaacaatgtgttacatttgacaaaacgtgtttagagtaagaaagactaactatactgtctgttatatttatttatgctttttgtagtttagctacatactataattttcattttaaacgttccttagttactacaaataatatttatgttttgcttcttcttagatgtaggcggatgcagaaatagaattatgttagagaaattattaaaagtttaattccagtaggcagttggagaaatctgaaactaatttgaaaaacttttatgctgtagtctcattagaatcattttaaaagcactgttcttgcatttttcctagactacagagagtgttctttgtcattttttttcctattctgttgtgaagtttattgtttcagttatttgagggaaataacctcttaatatgtttattttcctgaactaaagttttcatgtagagaatacaattaaatgttttgtgttatgacccaaactggctggaagtagagttcagagagggagaagggacaagaatcagtgtgggcatctcaggaaagtggcgccagtgctgggctccagccttctccactggcatgatgggtcctcagattctcctctggataatgagggtgttgggcactgtgagctctgacttctggggaggataggccatcatggactccatacacaattttgatgggtatcagttctcataaaatacctgctacaatttatttattttgtagttgtttagaaaactgtgagcagttgggcattagtaaattgtagttatatcttaacgatcttgggaatcattgaaatatgagtttttttccctcactcctatttatttaattaaaaaattagggaagttgttcattcacagctgtatattaatataaaatctctttataaaatgattcagagaaaaggcagtagtggtcacttactgtgctaaaatacctttttctctaaaaatatttaagctttagggtttgtcatagttttactttttaaattatactttgtgtaacaatttacgttaactagaaaaattagatatataataagttttggtactaagaaacatttacattctacactcattagtcaaatgaacttttctttcccagtgctaacagattttgtttcatgtgaagaaaaataaaatacaaatgaaataaaagtctagaaacagcaacaggaaactcaccacagaaataaagacataacccttgataagtttgtgtaagtgccagaattattggaagcaggtgacgaatgattaagaaaagctttattgtggggacatgctttaagaatcagctctgtatttgtgccaaggagatcaggtattggtgtgcaaacagatcccattaatactctgatttgaaccatgaattccacctactctgcgttgaagccctccagtagactgatagatgtaatcaaatgatcagctaccaagtttaattcctttgcctgtgtgtagcaacagttggtagttttacaagttaagttgatggtctggctgcagataagagaaagactcagtgataggtggtttgtgagtgaagtaacttccacactgtcaagagttgacagcatattaattgtgtggcattataattgtgagaaacaaatgagagcaaaatgttaggtcctttgacaagcattttcctcctgtttttaaaaagggctttaagttgtttcctatgtaaggtaatctttcttttttagtattatctaagaaggatggtagattatgtcattttggaaactattgtgtcccttgtattttaaatatttcaggaaaatgcctacgattgttacaaagatgtgtgttttacttataacataagctctgattctccagtggccactgggccttctctgtgctctgtattcaactgcagtatgaattacagaatgctgtgcatgttcgttagtaccaataccatgtgtatgtggtagaagttgtaaccagtttctggatctgtatggtactataaaatacttattttataattctgtaaccgtatggcagtgttatgccaaaaatgtataaagagcaatagtttttgttgcttactgctgtattttaaaatattgtttctaaaataatagagttagagttccttttgagtaattatttttaagaactattgccaaatatacatcctgtaaaactaataaaagccactccatcttagataacattttagcattgtgctagagtacattatggtgattttgcacgattaaaatatttttaaagaactagaaaaaa

SEQ ID NO: 162601 - DNA, 9345 bp, Homo sapiens
  Payload ID: 12035
  Gene Symbol: OPRD1
  Gene Name: opioid receptor, delta 1
  Uniprot ID: P41143
  ENST ID: ENST00000234961
  CDS Start-End: 243-1361
ccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggggcagtggtgtgcatgctccagttccccagccccagctggtactgggacacggtgaccaagatctgcgtgttcctcttcgccttcgtggtgcccatcctcatcatcaccgtgtgctatggcctcatgctgctgcgcctgcgcagtgtgcgcctgctgtcgggctccaaggagaaggaccgcagcctgcggcgcatcacgcgcatggtgctggtggttgtgggcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccgcgcccgcgaagccacggcccgcgagcgtgtcaccgcctgcaccccgtccgatggtcccggcggtggcgctgccgcctgaccaggccatccggcccccagagcgcccctccctagtgacccggaggccacatgagtcccagtgggaggcgcgagccatgatgtggagtggggcagtagaaggtcggaggcttgggaccgccagatggggcctctgtttcggagacgggaccgggccgctagatgggcatggggtgggcctctggtttggggcgaggcagaggacagatcaatggcgcagtgcctctggtctgggtgccccgtccacggctctaggtggggcgggaaagccagtgactccaggagaggagcgggacctgtggctctacaactgagtccttaaacagggcatctccaggaaggcggggcttcaaccttgagacagcttcggtttctaacttggagccggactttcggagttgggggtccgggcccaggacccagaaagggcagtggtggggacagttgcttgaaaactgagctgcaagactgggcctctgtgtagtagggaggagcctcctgtgaggggagacccagagacaggacagctgggtgtggctacagctgaagatttggtcaccagatagggcgcctgtgcaaagggcctgtggcctcatctttggatacgggatacagtcccagccctgagttctagcaaggggcaaggctcgctgaggtccaggtccgacttgacacctttataaatagaatataaaagactgaggggccaggcgtggtggctcaagcctgtaatcccagcactttgggaggccgaggcaggtggatggacatgagcccaggagttcgagactagtctgggcaacatgggagaccctgtcgctacaaaaaatacaaaattagccaggcatggtggtgtgtacctgcaggcctagctccttggaaggtgagaggatcacttgatcccaggagtttgaagctgcagtgagctatggtggtgccactgcactccagcctgggggacagagtaagactctgtctctcaaaaaggagagagagggagaatgagggaagaagagataggaagagagagaaacagtataccttttatctctttgacaggcatgtatttccttggaatgggcaggaatccctcagaatcggtggccacagtggggcttgggacaggacagcagagcggggggcagccactccaggatagggtaataagacaggaccttggttggagtagggtccccagaactgagtactaatgggggcccagaggcttgggaaggagaaggcttccaaaaccagttcgaaaacccagacccggagtggacctccgtgccaaggggtggtggtgggtgggtggaggaagaggtgggctcctgcttcaaggttaggtcttccagtggaaggtggatgctttctgtgagtccccagggccctagtttctctggcccagatactggaggacagaggaccacctacttagatcccgtagatggtaagtggtgcctgggactcttgagggcggggggcggggtatgagaagcatcagttcgcacttggtgctgggtcctgggccctgataagaacctggatgaaatcctcttccattctcccaacatctggctgcatccatgtgtctggtgtcaatgactccagtgaactggaactgcccatatggggacctgaccttgaaggaactggggggagaagcttttgtaactgcaatgccggcatcagtgtgtgtccccctctgcctttccccccaggctccccaggtcccccacctgctccagcccagctgtccccttcacgctgctgagagtgatatccacctggagttgggtgtagaagtttttcttttcattggttcggcattttattcaggcactcctggatctttgcttcccagaatatcagtgtctgtccttgttctctgtacctcccccgtgcctcatctcctctccctccgctgctgtcccctccctcaccaacactgcctcagtaatgcacccctgactccctattgaagcagtgtgctgacatccttgtaaaaacaaatttaattttcttccttttttgggacagatggaaagaaattgacgtctttgtctcaaacaaaagaaaaaagaaaaagaaacaatatacttcttttccctttgacagccatgtctttggaacaaaagctgggaggctgtcactccagcagggactgaatagcatgcagggggctggggacttaggcaccaagaggggctttgggcacattagggggaagggatgctctcagagggcaaagcacagcccccttctcagggtgaggctcccagcagccccagacccggggatgtgcctcctttgggaaatggctaccccgggtcctggaaagatgtggggccatgcccagcactcacatccagcctgccaagccattgtgacctggggtcccaagccacctagatcactctcactaccttgtgaccacagagacccctgtgtctgagggtgggaggtcgtcagcatggcaggagacacttctcctcatcaggggtcctcctgtgaatgctttgggggtatggcagaaaaagggacaatctaggaactggggaagactcctgaaggaggtgacattggagccaggctgtttactctccctgcaggacctgtgtcccctcccaggataggcctgtttcaaggctgcttgaagcccactcactgccatctcctgtgtctgtaacagatctggctgttttttgccccttctgatatgtaaatctgtcctgaggtcagcagggcccgggtccggaccacgtgtgtttaaggtagtgcaaacttgtattgaaatctacttcatgccaagcatgcactctgggcatcaggactcggaatgagtcagccttggccctgccctcagaaagcctgagccagtgttgggagataaagcatcaacagatgattgcacctcagtgtgatgagtgcggtgacagggagccccagggagggtgtcacagggaagtgccttttctagcttttcactaaaacacatgtttgtcgcagttctgtaagaggtggaaaagggtcggggaccctgaaggatgaataggagttggccaccaaaaagaggaaatagcgtgtgcggaggcatggggatgtttaaatgcttggcaaacccaacaagttgggtgcagctggagcatggggcttaactaagctcttctgtgtgccaggctctctgccaggtgtcttgtgtgcatcagcccacctgatcctcaggacagcctggtgaggaagtagtgttatccccattgaggacaaagagagctgaggctgagagaggtcaggctacttgctcctaagtcacagggcctgttcgtagtggcagaacttgggtccctggaattccagggtccatgtttccagttaattccaggcatcagtgaagtagaaaggccttagaagctggaaccccagaatgaggttttgaagacctaaaaccaaatggaaaaatctaaaggaaacgagcaattttccatgaacttttgttcctcctgaagctctccaaatcttcacgtttcagaatgtactgtgcatggtgcattttaaagctctaaattgacagtgtaattctagatcgtcacagggttctcaaaactgcagagtaggtctgtttcccccaaaatttccatttatctccctccaggaggagggagggaagtttttgcccctgatttcaaaatgtcctactgtttcagatctcttcttcttcatcatcttttttttttttttttcagccagtgtcttgctctgttgcccagtctggagtgcaagtgcagtggtgcagtcatagctcactgcagtctcaaactcctgggctcaagtgatcttcccacctcagcctcctgagaatctgggacgacgggtgtgtgacaccatgcccagcaattttatttttatttttattcatttattttgtttgggtttttttttttctgagacagggtctccctctgtcgcataggctggagtgcagtggcaccatctcggctcattgcaacctccgcctcctgggttcaagtcatcctcccgcctcagcctcctgagtagctgggattacaggtgtgcaccaccataacccagctaatatttttatttttagtagagacggggtttcaccatttggccaaactggtctcgaactcctgacctcaggggatctgcccgcctcagcttcccaaagtgctgggattacaggcgtgagccaccaagcccggccaatttttttttttttcaatagagaccagagtgtctctgtgttgcccagactggtcttgaacttctgtcctcaagcaattctcctgccttggcctcccaaagtactgggtttacaggtgtgagccactgtgcccagctctcatacctcgtcttgatgcagtagaagtagtggttaagcctggaatcagatcttggttttccctctctgagcctcagtttcctcatctgtagagtagacttccttcacgggtggttgtgaggatttaatgtatgtatagggataaggcccagaacgtaagtaaactctaagtacatggtaagtggcagtcactgcttacaagtggagccagggttcagggtcagagctagagacctacagggaagagtaggtgagctgtcggggctagtgatggagagagagaagagactggagatccagcttggggatccccttgcttcctggcccaggagccaccatggagagtgagaagctgccagagaagcaggaggaggatggagagaatgtgctaccatggaaactggaggaggagggcgttcccaggaggagggagtgatggataatgtcaagtgtcataagagaggatgcgagtagggagggcaggagggtgatgggagctctccaatttagttttttacatggcccaggcagcccccaagcctggatcaaatcccagctctcaagctaactggctgtgtgacctagacaagggatttgccttctctgagcttcagtttccttctagagttgagatgtgggaattggtccatctctaatacgatcatcagcctcacttaataagagtcctagctttgccgaattcttggccacgtgctagcagtgtgatcttaggcaagtcacttcacctccacgagagcactctctgaaagctagagatatggtaagcaaagtgccaccaaagtgcctggcacatagtggggcctcgatacaggcttattctctgataattacacgtgtgccagaggcagctgctctaaggaggcttgctgggcttggaattagaaatgctcctcaagggctgggtgcagtggctcacgcctgtaatcctagcactttgggaggccaaggcgggtggatcatgaggtcaggagttcaacaccagcctgaccaacatggtgaaaccctgtctgtactaaaaacacaaaaattagccaggcgtggtggcgtgcacctgtaatcccagctactcaggaggctgaggcgggagaatcgcctgaacccaggaagcagaggttacagtgagccaagatcttgccactgtactccagcctgggcgacagagcgagactctgtctgaaaaaaaaaaaaaattaaaaagaaatgctcctcaagttggagagggcccactagcatcctgagaggacttggaagaacaacagtccaggctgggcacctgctgggtctctgtccaaaggccagccctctctttgtgtcagccgcagatccctcacctagggcatgactactggctgccagctcccactaacacctgctgcagatccagactgaagccggccccagcggccccaaagcccctaggaagtgaccaccccccatccctggcacccagatcctggcccctgcactcacacacaaaacacatacagatgcctctctttcatcatgtatttattcctttatttctgggagccgggaggagtgacgggagcaaatcaggacctggccgccccacgctgagcttgcagatattgagagttgggtgacagatggctgtgtggttcaggctgcaggcagcttgggaattcaaaatggggcttagagaggagctggagggggccctcgaggtggacgtagtgatgcagtagggcatggcactgcgaggttgcccgggttctagtcccagcaccatcaccggggatgagccgtttcagagtgtggcactctgtcacactccatttcattgagaggccactgagacattatcaatgggtaatgtacagcacttccatggcataactcatttaatcttcacagcatgatgatgaggtaggcatagtatcattacctccattttacagatggggaaactgaggctcagagaagggaatgacttgcccaagaccacatggcttctcagtgattggctcagctaggatcccacctttggtccttcaagtccacttcctctgctttcctcttcctgcaccctgagaggaaatgctctgagtataccgagggtcctcaggagactctcacatccagctcacagtcacaggctgagcattccctgtgctgggttctgtacctcatcatgttggcagcagaggcacgtgccagctgctcaaaaaactgctgtaaccttggtagatccctctccccatccatttcttccttgccttggaagtcctgcttgtttgataattttctgactgactgccatgttgttgccttgtgaccttgggcatgtcatttcactctgagccatttctcagtcatggatgacagcacttagctgatgagaagttgagaagattcagaaagaggctatgagtgaaggaccttgtctgttttggtcatgaaagtgttcccaggaaatgcaaatggacacacagtagttatctactgagctaatgaacaatgtccctggtgcatagtaagtgcccaataaaatgcagcttttttcatattatctaatgttttaggccatgcctgcaccaacccatgcttctttttttttttctttctttctttctttttttttttttaagacagagtctcactctgtcacccaggctgaagtgcaatggcgagatctcggctcactgcaacctccgccgcccgggttcaagcaattctcctgcctcagcctgctgagtagctgggattacaggcacgtgcccggctaattttgtatttttagtagagacggggtttcgccgtgttggccaggctggtctcgaactcctgacctcaactgatccacccacctcggcctcccaaagtgctaggattacaggcatgagccaccgtgcccagcccaacccatggttcttaatgctgcaggtgggtccggagaaaggcttttctcttttaaccatctccttgaatttcagaaggtgggacaacatgtgctggaaagcagttcttaagaggacatcttttcccaagctccttagccttagctgtcctctcctgccctcaccaggactgccctctcagggacccaagaggaagggacagcctggaaaggaagaaggtcccgggccatctgcgtcatggggatggagtcccttggcgtgtgccggtgcaaatacactcctgtaacggggctcatctagaatctcctctcggaatgaggagaccgcaaatgtggttttgaatcttcattgtccacttcattgctgtggtgttgggcaggtctctgtccctctctgggcctctgcacgatggaggggtaggagttgatggttctgaaggctctgccatcctggaaaagaactgagacacttccctcatgttcctgggtcccagaaacagacatctgttggtaaaatctactgggcatttgcccagagacagggaaaagaatgcctgggggtctgtaataggagctgccccaattaggggcagggaggcgggcatgtaaaaaaggaagcttaaagctttgttttcaggctttttgcctaccccaggctccatcttggtaccaagtactcaaccttctgttttctcaataaagtgagccctcttctcggtgtctgca

SEQ ID NO: 162602 - DNA, 1217 bp, Homo sapiens
  Payload ID: 12035
  Gene Symbol: OPRD1
  Gene Name: opioid receptor, delta 1
  ENST ID: ENST00000621425
  CDS Start-End: 243-1217
ccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggggcagtggtgtgcatgctccagttccccagccccagctggtactgggacacggtgaccaagatctgcgtgttcctcttcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccgcgcccgcgaagccacggcccgcgagcgtgtcaccgcctgcaccccgtccgatggtcccggcggtggcgctgccgcctga

SEQ ID NO: 162603 - DNA, 5014 bp, Homo sapiens
  Payload ID: 12036
  Gene Symbol: OPRK1
  Gene Name: opioid receptor, kappa 1
  Uniprot ID: P41145
  ENST ID: ENST00000265572
  CDS Start-End: 299-1441
agccgcgtcccggctgcgtcccgccggtcccgccccgccccgccccgcagagccgccgccagtagtgggagacgtgcgctgagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccatagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtctgacatgaaaagatagaatttaaaataaacttttagagatctcatggtctgaagtcatcagatgcagaccacgttcgtgatcagtggaaacatcaaggacaaaaggtccacgcaacacatgcacctcttctctagggcacagaagcgaggcagagcctcagttcctctgatgaacaagggaacaggtcttttccttctggtttgctaggtaaggttcagcacccatctgctgtggccttcctatgaaacgtagtttcaaaagctcggtttaagaaaaaaggaaaagaaaaaacattgctttcagagctcaatgggcatccaatccagatgtttcacaatgacagcaacaacctccaacggaatgggaactatttccagggttcatgcccagctcactgtatgctgtgtggacatgcatttcatgtggctgtgtggtaagaattacagcttacatatggcttggacccacatctgaggaatctgatgttcacttataccagaacattatcttgctatttatgaaattatttaaacgttcaaaagattgtttttaacatggtttaatttcccaaaaactacagttttttttcttagcatgctattcaggtaaacagtcttataataaagcatgtcccattgtcaagaaacataaagtggtgtgaataccactgaaaatatatatatagtatcttctgtaaataatagtacctgtgtgaataaggaataggcttgcctcccagccaggcaatttcctgagggcacactaatgatatcccctgagttgctaagttgatgctgagacattttgctgggaattagtcatggcatgatctctttcagactccctgaataccatttagtcccgtaacagtgctcacaactcatgtgctaatgaatcacaaaggctttaactagctcccaggttgtagccttcgcaggatctagtttatttgccacatctctttatgaacatatagcgattcgcagatctctctattcacggagaggaaggtgttttgcttctgtagatctcaaggtactattttgtggctctcagcaggaagtagaattgttcctaaatgtgtgctgaatgaggacatgatgtccctcctggtgccaggacacatcctgcatggcattctgtgaagggcatacctgctgaggataatgccaggagcagcacatttagggtaattttgctaaaacttccagatgacatataaattccctctttttccccctgaaacttaccatttcagaggtaatggctttttctgtaatttgcctgagaagaaaaaagggataatttagaaataacactccaagcctatatattactagggctgcatcctctggaatttaatagaaaaattgaatatatagccctatgtaactacagacatcattacaactgttaagttctgttcaccatgcaagttctcggtggtgtatgtactctcaccttttggaaacaaaaccttgcattgaaggttttacacatggcttcagaatgttactctgaccatgtttgcctctactccagattatcatggcacctaacacagatgacatatggcagaatggaagtgatttctcctaatgaaaatgaagtgctcttttgagtatttcttgttttattgagattcctatctgcccttgtatttttataactgaatgtaaataggaattgcttaaatactggtttacactaatcccatagttaaaaatcttggctatggtacaggaaggatatctatatagaggatagttccagaaacaagccctggtgaaataggaaatataaaaacttctttatggaacaggaaaacccaagagactttctcgtcagattcctttccagtgcaaagtataacagagataggattatgagatgaaatcacagtagtgtgtttcctttaattttttctgtcttctttttttttttttttttttttgagacggagtctcgctctgttgcccaggctggagtgcggtagcacagtcttggctcactgcaacctccacctcctgggttcaagcgattctcctgcctctgcctcctaagtagctgggattacaggcgtgcaccgccaagcccggctaatttttgtatttttagtagagacggggtttcaccatgttatgcaggctggtctcaaactcctgacctcagaatattcacctgcctcggcctcccaaagtgctgggattacagatgtgaatggccacgcctggcctgtttcctttaagttagcacttcacgtgctcttacagcgttaattgccattattggtttgcctgattttcctgcatctcctcatatgtaagtctgcagcccaaggagagaatagtagctgtatgtgcccacaaggggtgtccaagcttcttgattcttgttaatatcgactccccaacattgaaaaaggagtgaagaagggaatatcattttagggtactgctttaaaggaatgataaagtaaacaacgtagcagggaaaataccacttgcacaaatgtatttctttgtcaaagtgtgtacacgctttctgtttgtcctgatgtcctgctgtgaagcagggaccacattgccatttattcattgttccaggcaatgcatttgtccaaacccctctggctctctgatatctctcatttcttgatgttcctattctctgacctcaacaaggaggacactgtctgttgtgtctctttgagactagaactccatgtgtttaaccttcagatccattctctacatgaaccctattctttccaccctggtaagaaggtctggaagacaggtcctaacgaggggtcagagaaggcacagagaaatgaaccagccatgcaggggcagcactgaggaggaaaccccccactctaactgggaggagagtggaaacactcttagtatctcagagtagttaccaatctaagagcatccttcgagtttaagtcaaaactctaggcttaataccaaaaataatacatcatttggaaaaatagcttggagaaaaaaaatcaataaagagtcacataaaatcttaagaaaatggttctattctgtgatatattactaagaaatacagttcttaaacgtgtataactattgtcagacaatttataggtgtttcatctagtcctgggatgaaatacgatgactcatgcaaattcagggagcacactggctgactttaaattggaacattgtaaagtgaaagctgtgaaaggttgtgtgtcctatcaatgagatttattttctaaccaagagctgttcggatgattcagtataaatacgaaaatcacatccaaaaacggtataacccagcttccttaaggcaattttcttctctgaaacaagaatatactcatatgttctttactataatgtatatgatttttatcttgtactttaaaagatgataattatgcattgtatatacgattgtgtgccttgcaataaaatcaaaactgtacctgctgaaaatca

SEQ ID NO: 162604 - DNA, 2041 bp, Homo sapiens
  Payload ID: 12036
  Gene Symbol: OPRK1
  Gene Name: opioid receptor, kappa 1
  ENST ID: ENST00000522508
  CDS Start-End: 219-569
gagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccatagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccggttggaatttcaatggaagacgacaaaaccatgtgatgaattgagagatcccaaagggactggtgtgaagccgggcagggaagccttggattaagaatggctggagtggccgggcgcggtggctcaggcccgtaatcccagcactttgggaggccgaggcaggtggatcacgagatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtctgacatgaaaagatagaatttaaaataaacttttagagatctcatggtctgaagtcatcagatgcagaccacgttcgtgatcagtggaaacatcaaggacaaaaggtccacgcaacacatgcacctcttctctagggcacagaagcgaggcagagcctcagttcctctgatgaacaagggaacaggtcttttccttctggtttgctaggtaaggttcagcacccatctgctgtggccttcctatgaaacgtagtttcaaaagctcggtttaagaaaaaaggaaaagaaaaaacattgctttcagagctcaatgggcatccaatccagatgtttcacaatgacagcaacaacctccaacggaatgggaactatttccagggttcatgcccagctcactgtatgctgtgtggacatgcatttca

SEQ ID NO: 162605 - DNA, 1602 bp, Homo sapiens
  Payload ID: 12036
  Gene Symbol: OPRK1
  Gene Name: opioid receptor, kappa 1
  Uniprot ID: P41145
  ENST ID: ENST00000520287
  CDS Start-End: 376-1518
gagctccgtgctgggaggtgggaagggggcttgaccctggggactcaggcagtctggggacagttccaccaggggccggtgcctagaattggtgagggaggcacctcaggggctgggggagaaggagcgagcgctcttcgcccctctctggcacccagcggcgcgcctgctggccggaaaggcagcgagaagtccgttctccctgtcctgcccccggcgacttgcggcccgggtgggagtccgcaggctccgggtccccagcgccgctggccagggcgcgggcaaagtttgcctctccgcgtccagccggttctttcgctcccgcagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtc

SEQ ID NO: 162606 - DNA, 1195 bp, Homo sapiens
  Payload ID: 12036
  Gene Symbol: OPRK1
  Gene Name: opioid receptor, kappa 1
  Uniprot ID: P41145
  ENST ID: ENST00000524278
  CDS Start-End: 226-1101
acatctcagcagataactttgttcccctcaccatcacacaagcaccagtgtctgccaattttgaagccaaccctcgtttctctgtaaagagaagtacgctaggatggtcttgagttaaagtgtcactggggagcatttctaagtctctggaacaccctccgccctgttgcctggccaccatagccttcccggtgctcacaactcaagttccccagatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtctgacatgaaa

SEQ ID NO: 162607 - DNA, 4682 bp, Homo sapiens
  Payload ID: 12036
  Gene Symbol: OPRK1
  Gene Name: opioid receptor, kappa 1
  ENST ID: ENST00000613482
  CDS Start-End: 1-1101
atggactccccgatccagatcttccgcggggagccgggccctacctgcgccccgagcgcctgcctgccccccaacagcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtctgacatgaaaagatagaatttaaaataaacttttagagatctcatggtctgaagtcatcagatgcagaccacgttcgtgatcagtggaaacatcaaggacaaaaggtccacgcaacacatgcacctcttctctagggcacagaagcgaggcagagcctcagttcctctgatgaacaagggaacaggtcttttccttctggtttgctaggtaaggttcagcacccatctgctgtggccttcctatgaaacgtagtttcaaaagctcggtttaagaaaaaaggaaaagaaaaaacattgctttcagagctcaatgggcatccaatccagatgtttcacaatgacagcaacaacctccaacggaatgggaactatttccagggttcatgcccagctcactgtatgctgtgtggacatgcatttcatgtggctgtgtggtaagaattacagcttacatatggcttggacccacatctgaggaatctgatgttcacttataccagaacattatcttgctatttatgaaattatttaaacgttcaaaagattgtttttaacatggtttaatttcccaaaaactacagttttttttcttagcatgctattcaggtaaacagtcttataataaagcatgtcccattgtcaagaaacataaagtggtgtgaataccactgaaaatatatatatagtatcttctgtaaataatagtacctgtgtgaataaggaataggcttgcctcccagccaggcaatttcctgagggcacactaatgatatcccctgagttgctaagttgatgctgagacattttgctgggaattagtcatggcatgatctctttcagactccctgaataccatttagtcccgtaacagtgctcacaactcatgtgctaatgaatcacaaaggctttaactagctcccaggttgtagccttcgcaggatctagtttatttgccacatctctttatgaacatatagcgattcgcagatctctctattcacggagaggaaggtgttttgcttctgtagatctcaaggtactattttgtggctctcagcaggaagtagaattgttcctaaatgtgtgctgaatgaggacatgatgtccctcctggtgccaggacacatcctgcatggcattctgtgaagggcatacctgctgaggataatgccaggagcagcacatttagggtaattttgctaaaacttccagatgacatataaattccctctttttccccctgaaacttaccatttcagaggtaatggctttttctgtaatttgcctgagaagaaaaaagggataatttagaaataacactccaagcctatatattactagggctgcatcctctggaatttaatagaaaaattgaatatatagccctatgtaactacagacatcattacaactgttaagttctgttcaccatgcaagttctcggtggtgtatgtactctcaccttttggaaacaaaaccttgcattgaaggttttacacatggcttcagaatgttactctgaccatgtttgcctctactccagattatcatggcacctaacacagatgacatatggcagaatggaagtgatttctcctaatgaaaatgaagtgctcttttgagtatttcttgttttattgagattcctatctgcccttgtatttttataactgaatgtaaataggaattgcttaaatactggtttacactaatcccatagttaaaaatcttggctatggtacaggaaggatatctatatagaggatagttccagaaacaagccctggtgaaataggaaatataaaaacttctttatggaacaggaaaacccaagagactttctcgtcagattcctttccagtgcaaagtataacagagataggattatgagatgaaatcacagtagtgtgtttcctttaattttttctgtcttctttttttttttttttttttttgagacggagtctcgctctgttgcccaggctggagtgcggtagcacagtcttggctcactgcaacctccacctcctgggttcaagcgattctcctgcctctgcctcctaagtagctgggattacaggcgtgcaccgccaagcccggctaatttttgtatttttagtagagacggggtttcaccatgttatgcaggctggtctcaaactcctgacctcagaatattcacctgcctcggcctcccaaagtgctgggattacagatgtgaatggccacgcctggcctgtttcctttaagttagcacttcacgtgctcttacagcgttaattgccattattggtttgcctgattttcctgcatctcctcatatgtaagtctgcagcccaaggagagaatagtagctgtatgtgcccacaaggggtgtccaagcttcttgattcttgttaatatcgactccccaacattgaaaaaggagtgaagaagggaatatcattttagggtactgctttaaaggaatgataaagtaaacaacgtagcagggaaaataccacttgcacaaatgtatttctttgtcaaagtgtgtacacgctttctgtttgtcctgatgtcctgctgtgaagcagggaccacattgccatttattcattgttccaggcaatgcatttgtccaaacccctctggctctctgatatctctcatttcttgatgttcctattctctgacctcaacaaggaggacactgtctgttgtgtctctttgagactagaactccatgtgtttaaccttcagatccattctctacatgaaccctattctttccaccctggtaagaaggtctggaagacaggtcctaacgaggggtcagagaaggcacagagaaatgaaccagccatgcaggggcagcactgaggaggaaaccccccactctaactgggaggagagtggaaacactcttagtatctcagagtagttaccaatctaagagcatccttcgagtttaagtcaaaactctaggcttaataccaaaaataatacatcatttggaaaaatagcttggagaaaaaaaatcaataaagagtcacataaaatcttaagaaaatggttctattctgtgatatattactaagaaatacagttcttaaacgtgtataactattgtcagacaatttataggtgtttcatctagtcctgggatgaaatacgatgactcatgcaaattcagggagcacactggctgactttaaattggaacattgtaaagtgaaagctgtgaaaggttgtgtgtcctatcaatgagatttattttctaaccaagagctgttcggatgattcagtataaatacgaaaatcacatccaaaaacggtataacccagcttccttaaggcaattttcttctctgaaacaagaatatactcatatgttctttactataatgtatatgatttttatcttgtactttaaaagatgataattatgcattgtatatacgattgtgtgccttgcaataaaatcaaaactgtacctgctgaaaatcacaacagtc

SEQ ID NO: 162608 - DNA, 5196 bp, Homo sapiens
  Payload ID: 12036
  Gene Symbol: OPRK1
  Gene Name: opioid receptor, kappa 1
  Uniprot ID: P41145
  ENST ID: ENST00000612786
  CDS Start-End: 740-1615
agccgcgtcccggctgcgtcccgccggtcccgccccgccccgccccgcagagccgccgccagtagtgggagacgtgcgctgagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccatagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccggttggaatttcaatggaagacgacaaaaccatgtgatgaattgagagatcccaaagggactggtgtgaagccgggcagggaagccttggattaagaatggctggagtggccgggcgcggtggctcaggcccgtaatcccagcactttgggaggccgaggcaggtggatcacgagatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtctgacatgaaaagatagaatttaaaataaacttttagagatctcatggtctgaagtcatcagatgcagaccacgttcgtgatcagtggaaacatcaaggacaaaaggtccacgcaacacatgcacctcttctctagggcacagaagcgaggcagagcctcagttcctctgatgaacaagggaacaggtcttttccttctggtttgctaggtaaggttcagcacccatctgctgtggccttcctatgaaacgtagtttcaaaagctcggtttaagaaaaaaggaaaagaaaaaacattgctttcagagctcaatgggcatccaatccagatgtttcacaatgacagcaacaacctccaacggaatgggaactatttccagggttcatgcccagctcactgtatgctgtgtggacatgcatttcatgtggctgtgtggtaagaattacagcttacatatggcttggacccacatctgaggaatctgatgttcacttataccagaacattatcttgctatttatgaaattatttaaacgttcaaaagattgtttttaacatggtttaatttcccaaaaactacagttttttttcttagcatgctattcaggtaaacagtcttataataaagcatgtcccattgtcaagaaacataaagtggtgtgaataccactgaaaatatatatatagtatcttctgtaaataatagtacctgtgtgaataaggaataggcttgcctcccagccaggcaatttcctgagggcacactaatgatatcccctgagttgctaagttgatgctgagacattttgctgggaattagtcatggcatgatctctttcagactccctgaataccatttagtcccgtaacagtgctcacaactcatgtgctaatgaatcacaaaggctttaactagctcccaggttgtagccttcgcaggatctagtttatttgccacatctctttatgaacatatagcgattcgcagatctctctattcacggagaggaaggtgttttgcttctgtagatctcaaggtactattttgtggctctcagcaggaagtagaattgttcctaaatgtgtgctgaatgaggacatgatgtccctcctggtgccaggacacatcctgcatggcattctgtgaagggcatacctgctgaggataatgccaggagcagcacatttagggtaattttgctaaaacttccagatgacatataaattccctctttttccccctgaaacttaccatttcagaggtaatggctttttctgtaatttgcctgagaagaaaaaagggataatttagaaataacactccaagcctatatattactagggctgcatcctctggaatttaatagaaaaattgaatatatagccctatgtaactacagacatcattacaactgttaagttctgttcaccatgcaagttctcggtggtgtatgtactctcaccttttggaaacaaaaccttgcattgaaggttttacacatggcttcagaatgttactctgaccatgtttgcctctactccagattatcatggcacctaacacagatgacatatggcagaatggaagtgatttctcctaatgaaaatgaagtgctcttttgagtatttcttgttttattgagattcctatctgcccttgtatttttataactgaatgtaaataggaattgcttaaatactggtttacactaatcccatagttaaaaatcttggctatggtacaggaaggatatctatatagaggatagttccagaaacaagccctggtgaaataggaaatataaaaacttctttatggaacaggaaaacccaagagactttctcgtcagattcctttccagtgcaaagtataacagagataggattatgagatgaaatcacagtagtgtgtttcctttaattttttctgtcttctttttttttttttttttttttgagacggagtctcgctctgttgcccaggctggagtgcggtagcacagtcttggctcactgcaacctccacctcctgggttcaagcgattctcctgcctctgcctcctaagtagctgggattacaggcgtgcaccgccaagcccggctaatttttgtatttttagtagagacggggtttcaccatgttatgcaggctggtctcaaactcctgacctcagaatattcacctgcctcggcctcccaaagtgctgggattacagatgtgaatggccacgcctggcctgtttcctttaagttagcacttcacgtgctcttacagcgttaattgccattattggtttgcctgattttcctgcatctcctcatatgtaagtctgcagcccaaggagagaatagtagctgtatgtgcccacaaggggtgtccaagcttcttgattcttgttaatatcgactccccaacattgaaaaaggagtgaagaagggaatatcattttagggtactgctttaaaggaatgataaagtaaacaacgtagcagggaaaataccacttgcacaaatgtatttctttgtcaaagtgtgtacacgctttctgtttgtcctgatgtcctgctgtgaagcagggaccacattgccatttattcattgttccaggcaatgcatttgtccaaacccctctggctctctgatatctctcatttcttgatgttcctattctctgacctcaacaaggaggacactgtctgttgtgtctctttgagactagaactccatgtgtttaaccttcagatccattctctacatgaaccctattctttccaccctggtaagaaggtctggaagacaggtcctaacgaggggtcagagaaggcacagagaaatgaaccagccatgcaggggcagcactgaggaggaaaccccccactctaactgggaggagagtggaaacactcttagtatctcagagtagttaccaatctaagagcatccttcgagtttaagtcaaaactctaggcttaataccaaaaataatacatcatttggaaaaatagcttggagaaaaaaaatcaataaagagtcacataaaatcttaagaaaatggttctattctgtgatatattactaagaaatacagttcttaaacgtgtataactattgtcagacaatttataggtgtttcatctagtcctgggatgaaatacgatgactcatgcaaattcagggagcacactggctgactttaaattggaacattgtaaagtgaaagctgtgaaaggttgtgtgtcctatcaatgagatttattttctaaccaagagctgttcggatgattcagtataaatacgaaaatcacatccaaaaacggtataacccagcttccttaaggcaattttcttctctgaaacaagaatatactcatatgttctttactataatgtatatgatttttatcttgtactttaaaagatgataattatgcattgtatatacgattgtgtgccttgcaataaaatcaaaactgtacctgctgaaaatcacaacagtc

SEQ ID NO: 162609 - DNA, 1465 bp, Homo sapiens
  Payload ID: 12037
  Gene Symbol: OPRM1
  Gene Name: opioid receptor, mu 1
  Uniprot ID: P35372
  ENST ID: ENST00000229768
  CDS Start-End: 51-1391
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagtgcctacctataccttccctgtcttgctgggctctagagcaaggctgcttggttgtgtaccctggaccactgcaaggacctcttgtcagatatgacctcccagctatccttcactcgtcctgccttcgtggaaatactgctcccagcccgtctggtggagcatttctcctgagttaagcatgattattcttcagttgcccgacactgcccttgactcccttccaaattcggcattttcacatcagtatggc

SEQ ID NO: 162610 - DNA, 2178 bp, Homo sapiens
  Payload ID: 12037
  Gene Symbol: OPRM1
  Gene Name: opioid receptor, mu 1
  Uniprot ID: P35372
  ENST ID: ENST00000330432
  CDS Start-End: 238-1440
gatgagcctctgtgaactactaaggtgggagggggctatacgcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctgcttttaggtcatccaacctctttcctctctggccactctgctctgcacattagagggacagccaaaagtaagtggagcatttggaaggaaaggaatataccacaccgaggagtccagtttgtgcaagacacccagtggaaccaaaacccatcgtggtatgtgaattgaagtcatcataaaaggtgacccttctgtctgtaagattttattttcaagcaaatatttatgacctcaacaaagaagaaccatcttttgttaagttcaccgtagtaacacataaagtaaatgctacctctgatcaaagcaccttgaatggaaggtccgagtctttttagtgttttgcaagggaatgaatccattattctattttagacttttaacttcaccttaaaattagcatctggctaaggcatcattttcacctccatttcttggttttgtattgtttaaaaaaataacatctctttcatctagctccataattgcaagggaagagattagcatgaaaggtaatctgaaacacagtcatgtgtcagctgtagaaaggttgattctcatgcactgcaaatacttccaaagagtcatcatgggggatttttcattcttaggctttcagtggtttgttcct

SEQ ID NO: 162611 - DNA, 1389 bp, Homo sapiens
  Payload ID: 12037
  Gene Symbol: OPRM1
  Gene Name: opioid receptor, mu 1
  Uniprot ID: P35372
  ENST ID: ENST00000337049
  CDS Start-End: 51-1307
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagccacccttggcagtcagcatggcccagatctttacacgatatcctcctccgactcatcgtgagaaaacctgcaatgattacatgaagaggtagataatgtattaccctgatttggtaggtaaagtattatcctgatttatgtgacagagtgaaaggcaacttttaattgttaacc

SEQ ID NO: 162612 - DNA, 1737 bp, Homo sapiens
  Payload ID: 12037
  Gene Symbol: OPRM1
  Gene Name: opioid receptor, mu 1
  ENST ID: ENST00000360422
  CDS Start-End: 258-1688
gctaccaaagactaactctatctctctccccaacccttctctccatctccctcctttagatgtgtttgcacagaagagtgcccagtgaagagacctactccttggatcgctttgcgcaaaatccaccccttttccctcctccctcccttccagcctccgaatcccgcatggcccacgctcccctcctgcagcggtgcggggcaggtgatgagcctctgtgaactactaaggtgggagggggctatacgcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagaattattatataattcatagatgttgctgcaatacccctcttatttctcaaaagccagtcttgctctggttctgtgattaaagagagagggtgagtgccttgcccactgtggtcatggatgcaagatatt

SEQ ID NO: 162613 - DNA, 2033 bp, Homo sapiens
  Payload ID: 12037
  Gene Symbol: OPRM1
  Gene Name: opioid receptor, mu 1
  Uniprot ID: P35372
  ENST ID: ENST00000434900
  CDS Start-End: 519-2000
cctgtaaagaaaatgatgagggctaaatccatcagcaccaaagctgggaagccctccaggttcatttggaagaaaatactcctctgagctcaaaggaagtgtgatctgtcacaatattgtatgcctgcactaagtttgcatcctgaaaactcactggaagataggaaagcaagcatgaaaaagcagccgggtcagacaggcttctggattcagtgtgtggacatgactttgcctgcatgaattgcccctttctcctacaaacaagagaattcggtcaagtggatgtggcagaactgggctgctctgagatgatagaaaagggctcctgcttttcctgtaattgcagccccttgttcttgtggttgctacatgcaataaatgtaattctatgagaaggaccagcccttacatcccatcaaaatgtttcctggaaacctggagcacagaactctgatatcctctcacactgtggcaggagaagcagcacaaggcacaatgctgaaatagcatggtccaggatgtgtttgcacagaagagtgcccagtgaagagacctactccttggatcgctttgcgcaaaatccaccccttttccctcctccctcccttccagcctccgaatcccgcatggcccacgctcccctcctgcagcggtgcggggcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagc

SEQ ID NO: 162614 - DNA, 2485 bp, Homo sapiens
  Payload ID: 12037
  Gene Symbol: OPRM1
  Gene Name: opioid receptor, mu 1
  Uniprot ID: P35372
  ENST ID: ENST00000414028
  CDS Start-End: 51-1262
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagggacctccagccaagtttgttgctgaccaacttgccgggtcgtcttgaaaagggggcttacaggtgttccaagcccgtgttttatcctgaagtatccctcaacacagaaaaacgacctcataacacaaaatacaccagcttaaaaatagcctttgaattatttttcacattaatcaaaactttacagaggagataaacactgatttttttattttattttattttattttattttattttattgccattcattcaaccgtttgcacagagagaaagaagacagaaatctgactggtaagaaattgttacccttttgccagcatgccaggcttctgggttccctttccctgagcggccctagtgatccggcttgcggcaccatcgcctacgggccaagctgcatcataaaggaaatttttttttttcattctggccagagcaaaacacatgtgataaaacataggcattagctactctgcttagcaccaaatatcagactagcttaaatttgcccccagatgggttccatcatctttaatccgacctctgacttgcagtttcaacacgtgctctctgggcaaaacagttgccctgagtaacagaaaagataggaaaggaaaaggagagagagaaaaacgtgccagtggaagggtggggaaggtgaaatgatcaaggaggccagagaaagactcacctattgcagcaacactgtagaagttcaggcagctgcttctcggtagcaaaaggatcttttccagcaatcctattagctctcaagtttccccttttagggaggaaaaagctccccatgtcccgcgatcctgtacatgtccaaccctgccatccacagccatcagcaaagagtgcaagacagattaatccaaagagaatagcaattaatatcccatagcatcaaagctgttcttagccaagagggactttaacgagaggggtctctaacaccctaaatcttagaagagactctaaccatcctaagtagggcctctaaccccgctttataaacttttaattgactcccatcttaacagttgcaatccatggaggaatgcttgataacctcggtgataagataaaaaaccaagcatactagaagtgttctctaaaattaaaaatacagtagttactagagaaaaattttagtccaaaaatccaactatagaaacatagaatgtgagaggtagcacataagaaataagtcatggggattttatttcatggaccagcaatatgatgataaaagccatctaacc

SEQ ID NO: 162615 - DNA, 1402 bp, Homo sapiens
  Payload ID: 12037
  Gene Symbol: OPRM1
  Gene Name: opioid receptor, mu 1
  Uniprot ID: P35372
  ENST ID: ENST00000419506
  CDS Start-End: 51-1313
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcaggtggaattgaacctggactgtcactgtgaaaatgcaaagccttggccactgagctacaatgcagggcagtctccatttcccttcccaggaagagtctagagcattaattttgagtttgcaaaggcttgtaactatttcatatgatttttagagctgactatgacatgaaccctaaaattcctgttccc

SEQ ID NO: 162616 - DNA, 1352 bp, Homo sapiens
  Payload ID: 12037
  Gene Symbol: OPRM1
  Gene Name: opioid receptor, mu 1
  Uniprot ID: P35372
  ENST ID: ENST00000452687
  CDS Start-End: 90-1310
gaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagaaaatagatttatttcaaaagtcatctttactcaactgtgagcataccaagggctaataattacaatattttcccgtgaaagaatataagattggaagc

SEQ ID NO: 162617 - DNA, 1481 bp, Homo sapiens
  Payload ID: 12037
  Gene Symbol: OPRM1
  Gene Name: opioid receptor, mu 1
  Uniprot ID: P35372
  ENST ID: ENST00000428397
  CDS Start-End: 197-1375
gcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcaggtacgcagtctctagaattaggtatatctactggggatgacataaaaattataaggctttgtgctaaactaggagtttaatccattatagaggatgagaatggagggaagaggggaagcaa

SEQ ID NO: 162618 - DNA, 2217 bp, Homo sapiens
  Payload ID: 12037
  Gene Symbol: OPRM1
  Gene Name: opioid receptor, mu 1
  Uniprot ID: P35372
  ENST ID: ENST00000435918
  CDS Start-End: 51-1244
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagagagaaagaagacagaaatctgactggtaagaaattgttacccttttgccagcatgccaggcttctgggttccctttccctgagcggccctagtgatccggcttgcggcaccatcgcctacgggccaagctgcatcataaaggaaatttttttttttcattctggccagagcaaaacacatgtgataaaacataggcattagctactctgcttagcaccaaatatcagactagcttaaatttgcccccagatgggttccatcatctttaatccgacctctgacttgcagtttcaacacgtgctctctgggcaaaacagttgccctgagtaacagaaaagataggaaaggaaaaggagagagagaaaaacgtgccagtggaagggtggggaaggtgaaatgatcaaggaggccagagaaagactcacctattgcagcaacactgtagaagttcaggcagctgcttctcggtagcaaaaggatcttttccagcaatcctattagctctcaagtttccccttttagggaggaaaaagctccccatgtcccgcgatcctgtacatgtccaaccctgccatccacagccatcagcaaagagtgcaagacagattaatccaaagagaatagcaattaatatcccatagcatcaaagctgttcttagccaagagggactttaacgagaggggtctctaacaccctaaatcttagaagagactctaaccatcctaagtagggcctctaaccccgctttataaacttttaattgactcccatcttaacagttgcaatccatggaggaatgcttgataacctcggtgataagataaaaaaccaagcatactagaagtgttctctaaaattaaaaatacagtagttactagagaaaaattttagtccaaaaatccaactatagaaacatagaatgtgagaggtagcacataagaaataagtcatggggattttatttcatggaccagcaatatgatgataaaagccatctaacc

SEQ ID NO: 162619 - DNA, 1468 bp, Homo sapiens
  Payload ID: 12037
  Gene Symbol: OPRM1
  Gene Name: opioid receptor, mu 1
  Uniprot ID: P35372
  ENST ID: ENST00000522739
  CDS Start-End: 71-1279
gcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagatcagagatccaatatcaaaccttcccagggtgtctgtattctgacaactgtccactgaggcaatttccatacagcgcaaagtggagtggcgatttggcagttatcaagctagaaaatctggaagcagaaactgctccgttgccctaacagggtctcatgccattccgaccttcaccaagcttagaagccaccatgtatgtggaagcaggttgcttcaagaatgtgtaggaggc

SEQ ID NO: 162620 - DNA, 2459 bp, Homo sapiens
  Payload ID: 12037
  Gene Symbol: OPRM1
  Gene Name: opioid receptor, mu 1
  Uniprot ID: P35372
  ENST ID: ENST00000522236
  CDS Start-End: 1309-2211
ggctagcatgctaattaactatgcataaccacgtttcctttcaccatgttgaaccctgacataatttttttttccacaaacacctcactctggagaaggaaatgattttttttaattaaaataaacatacattggaaatacttagtgctaaaataagcctgaaggaaaggttggaagtatgatgagtcagaaaactgactgtaaagaaaccaattacttaacataaaacaccattaaagataagccacgaaatgtaaggtctgctgggtaggaaagtggcaaatgcaatgaagcatgtctttagatcatgcaggtctataaccaacggtgaatctagcaaaagttattttctcttttggggagaaacttcttcttattaaaaaaataaaaaatgtttcaacttcttgagcaccaaggtcaattattctaaatcttaaaaccacagttttaattttgcttttttgttggtttttgtactttggagtatttgtctacattatcctttttatatttgccatatttaaagtccaaactaaaagcaaattattttctctcctcaagttaaatggctctatctttttctttaaaatccattaagaaagtgaaactcccaaagtaagtccaaaaaaaagcccccaagtctgaaaatgtggagcttttctggcagtaatgcagcttctgcaagtattgcagaccagatcaggtatcagaattttaaagcttcagtaacaaagctgtcctattgaccctgaggagatttatgaaatcactttcctgatgttattgaaaccaaaacactttcctggacactgaattcagtcctaaacaaagggcctccaaccaacagctgtcttgggctgaatgagttagactcaacctcgtgtgacggaaaaacagtaaacacaagctaacatttaaaaggaattgatggcaccgtgtaaatcagaagcccaaggagggcctggcttcaggtgtggggttctctctcacgctctcaaatccacatcctccggattaggtccattttcagacaagctcctccagcaactacataccatgcgtcttctcaggtgtgggtcctgcaggaaaactaatacactctttgtccataagtctcaaaataaactctcactggctctggttggaacatgagagcatccttgccattcaccatggccccggtcactaaacgtcttcacgccctggactggtaatacagcctatcccaaagcacctggactgagaacgggaaatgagtggttcccagagtgaaactgaggtactattactaaattaagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctgcttttaggtcatccaacctctttcctctctggccactctgctctgcacattagagggacagccaaaagtaagtggagcatttggaaggaaaggaatataccacaccgaggagtccagtttgtgcaagacacccagtgg

SEQ ID NO: 162621 - DNA, 2440 bp, Homo sapiens
  Payload ID: 12037
  Gene Symbol: OPRM1
  Gene Name: opioid receptor, mu 1
  Uniprot ID: P35372
  ENST ID: ENST00000522555
  CDS Start-End: 1290-2192
ggctagcatgctaattaactatgcataaccacgtttcctttcaccatgttgaaccctgacataatttttttttccacaaacacctcactctggagaaggaaatgattttttttaattaaaataaacatacattggaaatacttagtgctaaaataagcctgaaggaaaggttggaagtatgatgagtcagaaaactgactgtaaagaaaccaattacttaacataaaacaccattaaagataagccacgaaatgtaaggtctgctgggtaggaaagtggcaaatgcaatgaagcatgtctttagatcatgcaggtctataaccaacggtgaatctagcaaaagttattttctcttttggggagaaacttcttcttattaaaaaaataaaaaatgtttcaacttcttgagcaccaaggtcaattattctaaatcttaaaaccacagttttaattttgcttttttgttggtttttgtactttggagtatttgtctacattatcctttttatatttgccatatttaaagtccaaactaaaagcaaattattttctctcctcaagttaaatggctctatctttttctttaaaatccattaagaaagtgaaactcccaaagtaagtccaaaaaaaagcccccaagtctgaaaatgtggagcttttctggcagtaatgcagcttctgcaagtattgcagaccagatcaggtatcagaattttaaagcttcagtaacaaagctgtcctattgaccctgaggagatttatgaaatcactttcctgatgttattgaaaccaaaacactttcctggacactgaattcagtcctaaacaaagggcctccaaccaacagctgtcttgggctgaatgagttagactcaacctcgtgtgacggaaaaacagtaaacacaagctaacatttaaaaggaattgatggcaccgtgtaaatcagaagcccaaggagggcctggcttcaggtgtggggttctctctcacgctctcaaatccacatcctccggattaggtccattttcagacaagctcctccagcaactacataccatgcgtcttctcaggtgtgggtcctgcaggaaaactaatacactctttgtccataagtctcaaaataaactctcactggctctggttggaacatgagagcatccttgccattcaccatggccccggtcactaaacgtcttcacgccctggactggtaatacagcctatcccaaagcacctggactgagaacgggaaatgagtggttcccagagtgaaactgagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctgcttttaggtcatccaacctctttcctctctggccactctgctctgcacattagagggacagccaaaagtaagtggagcatttggaaggaaaggaatataccacaccgaggagtccagtttgtgcaagacacccagtgg

SEQ ID NO: 162622 - DNA, 1251 bp, Homo sapiens
  Payload ID: 12037
  Gene Symbol: OPRM1
  Gene Name: opioid receptor, mu 1
  Uniprot ID: P35372
  ENST ID: ENST00000524163
  CDS Start-End: 51-1220
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagagctgactatgacatgaaccctaaaattcctgttccc

SEQ ID NO: 162623 - DNA, 1001 bp, Homo sapiens
  Payload ID: 12037
  Gene Symbol: OPRM1
  Gene Name: opioid receptor, mu 1
  ENST ID: ENST00000520282
  CDS Start-End: 514-1001
gtcttcctgtaaagaaaatgatgagggctaaatccatcagcaccaaagctgggaagccctccaggttcatttggaagaaaatactcctctgagctcaaaggaagtgtgatctgtcacaatattgtatgcctgcactaagtttgcatcctgaaaactcactggaagataggaaagcaagcatgaaaaagcagccgggtcagacaggcttctggattcagtgtgtggacatgactttgcctgcatgaattgcccctttctcctacaaacaagagaattcggtcaagtggatgtggcagaactgggctgctctgagatgatagaaaagggctcctgcttttcctgtaattgcagccccttgttcttgtggttgctacatgcaataaatgtaattctatgagaaggaccagcccttacatcccatcaaaatgtttcctggaaacctggagcacagaactctgatatcctctcacactgtggcaggagaagcagcacaaggcacaatgctgaaatagcatggtccaggccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggc

SEQ ID NO: 162624 - DNA, 1060 bp, Homo sapiens
  Payload ID: 12037
  Gene Symbol: OPRM1
  Gene Name: opioid receptor, mu 1
  Uniprot ID: P35372
  ENST ID: ENST00000518759
  CDS Start-End: 13-972
cctgtaaagaaaatgatgagggctaaatccatcagcaccaaagctgggaagccctccagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctc

SEQ ID NO: 162625 - DNA, 1045 bp, Homo sapiens
  Payload ID: 12037
  Gene Symbol: OPRM1
  Gene Name: opioid receptor, mu 1
  Uniprot ID: P35372
  ENST ID: ENST00000524150
  CDS Start-End: 67-627
ggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagccacccttggcagtcagcatggcccagatctttacacgatatcctcctccgactcatcgtgagaaaacctgcaatgattacatgaagaggtagataatgtattaccctgatttggtaggtaaagtattatcctgatttatgtgacagagtgaaaggcaacttttaatt

SEQ ID NO: 162626 - DNA, 1519 bp, Homo sapiens
  Payload ID: 12037
  Gene Symbol: OPRM1
  Gene Name: opioid receptor, mu 1
  Uniprot ID: P35372
  ENST ID: ENST00000520708
  CDS Start-End: 529-1431
cctgtaaagaaaatgatgagggctaaatccatcagcaccaaagctgggaagccctccaggttcatttggaagaaaatactcctctgagctcaaaggaagtgtgatctgtcacaatattgtatgcctgcactaagtttgcatcctgaaaactcactggaagataggaaagcaagcatgaaaaagcagccgggtcagacaggcttctggattcagtgtgtggacatgactttgcctgcatgaattgcccctttctcctacaaacaagagaattcggtcaagtggatgtggcagaactgggctgctctgagatgatagaaaagggctcctgcttttcctgtaattgcagccccttgttcttgtggttgctacatgcaataaatgtaattctatgagaaggaccagcccttacatcccatcaaaatgtttcctggaaacctggagcacagaactctgatatcctctcacactgtggcaggagaagcagcacaaggcacaatgctgaaatagcatggtccaggatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctc

SEQ ID NO: 162627 - DNA, 2594 bp, Homo sapiens
  Payload ID: 12037
  Gene Symbol: OPRM1
  Gene Name: opioid receptor, mu 1
  Uniprot ID: P35372
  ENST ID: ENST00000519083
  CDS Start-End: 51-1259
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagatcagagatccaatatcaaaccttcccagggtgtctgtattctgacaactgtccactgaggcaatttccatacagcgcaaagtggagtggcgatttggcagttatcaagggacctccagccaagtttgttgctgaccaacttgccgggtcgtcttgaaaagggggcttacaggtgttccaagcccgtgttttatcctgaagtatccctcaacacagaaaaacgacctcataacacaaaatacaccagcttaaaaatagcctttgaattatttttcacattaatcaaaactttacagaggagataaacactgatttttttattttattttattttattttattttattttattgccattcattcaaccgtttgcacagagagaaagaagacagaaatctgactggtaagaaattgttacccttttgccagcatgccaggcttctgggttccctttccctgagcggccctagtgatccggcttgcggcaccatcgcctacgggccaagctgcatcataaaggaaatttttttttttcattctggccagagcaaaacacatgtgataaaacataggcattagctactctgcttagcaccaaatatcagactagcttaaatttgcccccagatgggttccatcatctttaatccgacctctgacttgcagtttcaacacgtgctctctgggcaaaacagttgccctgagtaacagaaaagataggaaaggaaaaggagagagagaaaaacgtgccagtggaagggtggggaaggtgaaatgatcaaggaggccagagaaagactcacctattgcagcaacactgtagaagttcaggcagctgcttctcggtagcaaaaggatcttttccagcaatcctattagctctcaagtttccccttttagggaggaaaaagctccccatgtcccgcgatcctgtacatgtccaaccctgccatccacagccatcagcaaagagtgcaagacagattaatccaaagagaatagcaattaatatcccatagcatcaaagctgttcttagccaagagggactttaacgagaggggtctctaacaccctaaatcttagaagagactctaaccatcctaagtagggcctctaaccccgctttataaacttttaattgactcccatcttaacagttgcaatccatggaggaatgcttgataacctcggtgataagataaaaaaccaagcatactagaagtgttctctaaaattaaaaatacagtagttactagagaaaaattttagtccaaaaatccaactatagaaacatagaatgtgagaggtagcacataagaaataagtcatggggattttatttcatggaccagcaatatgatgataaaagccatctaacc

SEQ ID NO: 162628 - DNA, 1261 bp, Homo sapiens
  Payload ID: 12038
  Gene Symbol: OPN1LW
  Gene Name: opsin 1 (cone pigments), long-wave-sensitive
  Uniprot ID: P04000
  ENST ID: ENST00000369951
  CDS Start-End: 61-1155
cgtgaccctcaggtgatgcgccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaa

SEQ ID NO: 162629 - DNA, 592 bp, Homo sapiens
  Payload ID: 12038
  Gene Symbol: OPN1LW
  Gene Name: opsin 1 (cone pigments), long-wave-sensitive
  ENST ID: ENST00000442922
  CDS Start-End: 1-495
atcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaatttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgc

SEQ ID NO: 162630 - DNA, 588 bp, Homo sapiens
  Payload ID: 12039
  Gene Symbol: OPN1MW
  Gene Name: opsin 1 (cone pigments), medium-wave-sensitive
  ENST ID: ENST00000596998
  CDS Start-End: 1-493
cacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaatttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatcttt

SEQ ID NO: 162631 - DNA, 1242 bp, Homo sapiens
  Payload ID: 12039
  Gene Symbol: OPN1MW
  Gene Name: opsin 1 (cone pigments), medium-wave-sensitive
  Uniprot ID: P04001
  ENST ID: ENST00000595290
  CDS Start-End: 83-1177
cccactggccggtataaagcaccgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctcc

SEQ ID NO: 162632 - DNA, 1261 bp, Homo sapiens
  Payload ID: 12040
  Gene Symbol: OPN1MW2
  Gene Name: opsin 1 (cone pigments), medium-wave-sensitive 2
  Uniprot ID: P04001
  ENST ID: ENST00000369929
  CDS Start-End: 61-1155
cgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccctacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaa

SEQ ID NO: 162633 - DNA, 590 bp, Homo sapiens
  Payload ID: 12040
  Gene Symbol: OPN1MW2
  Gene Name: opsin 1 (cone pigments), medium-wave-sensitive 2
  ENST ID: ENST00000430419
  CDS Start-End: 1-493
cacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaatttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgc

SEQ ID NO: 162634 - DNA, 1998 bp, Homo sapiens
  Payload ID: 12041
  Gene Symbol: OPN1MW3
  Gene Name: opsin 1 (cone pigments), medium-wave-sensitive 3
  Uniprot ID: P04001
  ENST ID: ENST00000599405
  CDS Start-End: 83-1177
cccactggccggtataaagcaccgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccctacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaagtcacagaggctttcactgcagtgtgggaccacctgagcctctgcgtgtgcaggcactgggtctcgagagggtgcaagggggataaagaggagagagcgcttcatagactttaagttttcccgagcctcatgtctaccgatggcgtgaaaggatcctggcaaaacagaagtgtgaggcaggtgggcgtctatatccatttcaccaggctggtggttacataatcggcaagcaagagctgtggaggggcttgctggatgccctcagcacccaggaggagggagggagctagcaagctaaggcaggtggccctcctggccccttaaggtccatctgctggaggcccagagtccttggagtacagtctacacctggaggggacccattcctgccagtctgtggcagggatggcgcgccacctctgccaggccaggaccccaagcccgatcagcatcagcatggtgcaggtgcacaggcgtgagctgatcagtgacgaggggcaggcacacaaggtggagacaaagaccaagaggacggttgccagtgagaggcgcggactcaggaacttgaacaacatctgcgggggacggctttggaggtgctccgctgcctccagttgggtgacttgctgtagcatctccagcttggatattcggctcttgaaggtctccgtgatctcctgcaggagacgaaaatgcacgcaccagaagtca

SEQ ID NO: 162635 - DNA, 1096 bp, Homo sapiens
  Payload ID: 12042
  Gene Symbol: OPN1SW
  Gene Name: opsin 1 (cone pigments), short-wave-sensitive
  Uniprot ID: P03999
  ENST ID: ENST00000249389
  CDS Start-End: 1-1047
atgagaaaaatgtcggaggaagagttttatctgttcaaaaatatctcttcagtggggccgtgggatgggcctcagtaccacattgcccctgtctgggccttctacctccaggcagctttcatgggcactgtcttccttatagggttcccactcaatgccatggtgctggtggccacactgcgctacaaaaagttgcggcagcccctcaactacattctggtcaacgtgtccttcggaggcttcctcctctgcatcttctctgtcttccctgtcttcgtcgccagctgtaacggatacttcgtcttcggtcgccatgtttgtgctttggagggcttcctgggcactgtagcaggtctggttacaggatggtcactggccttcctggcctttgagcgctacattgtcatctgtaagcccttcggcaacttccgcttcagctccaagcatgcactgacggtggtcctggctacctggaccattggtattggcgtctccatcccacccttctttggctggagccggttcatccctgagggcctgcagtgttcctgtggccctgactggtacaccgtgggcaccaaataccgcagcgagtcctatacgtggttcctcttcatcttctgcttcattgtgcctctctccctcatctgcttctcctacactcagctgctgagggccctgaaagctgttgcagctcagcagcaggagtcagctacgacccagaaggctgaacgggaggtgagccgcatggtggttgtgatggtaggatccttctgtgtctgctacgtgccctacgcggccttcgccatgtacatggtcaacaaccgtaaccatgggctggacttacggcttgtcaccattccttcattcttctccaagagtgcttgcatctacaatcccatcatctactgcttcatgaataagcagttccaagcttgcatcatgaagatggtgtgtgggaaggccatgacagatgaatccgacacatgcagctcccagaaaacagaagtttctactgtctcgtctacccaagttggccccaactgaggacccaatattggcctgtttgcaacagctagaattaaattttactttt

SEQ ID NO: 162636 - DNA, 2620 bp, Homo sapiens
  Payload ID: 12043
  Gene Symbol: OPN3
  Gene Name: opsin 3
  Uniprot ID: Q9H1Y3
  ENST ID: ENST00000366554
  CDS Start-End: 108-1316
atggctagagcaggcggcggagccccaaccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctataaaagttgtctccccttgtttcctttccattctggcacatgtagacatttaatttatgaataaaaccctttcctgtccttca

SEQ ID NO: 162637 - DNA, 2308 bp, Homo sapiens
  Payload ID: 12044
  Gene Symbol: OPN4
  Gene Name: opsin 4
  Uniprot ID: Q9UHM6
  ENST ID: ENST00000241891
  CDS Start-End: 168-1604
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcaggagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtatgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 162638 - DNA, 2401 bp, Homo sapiens
  Payload ID: 12044
  Gene Symbol: OPN4
  Gene Name: opsin 4
  Uniprot ID: Q9UHM6
  ENST ID: ENST00000372071
  CDS Start-End: 228-1697
ataactgcgacactcactcatttgcgcttcaccagacacagagcaaccgccagccccaagagcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcagagctgtgcttcgtggagtcactgtgatgatgcagagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtatgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 162639 - DNA, 1653 bp, Homo sapiens
  Payload ID: 12044
  Gene Symbol: OPN4
  Gene Name: opsin 4
  ENST ID: ENST00000443292
  CDS Start-End: 168-1653
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcagagctgtgcttcgtggagtcactgtgatgatgcagagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaggcgagcttcatcaggcaggagccagaggccagagagacagcgtgcagctccag

SEQ ID NO: 162640 - DNA, 1801 bp, Homo sapiens
  Payload ID: 12045
  Gene Symbol: OPN5
  Gene Name: opsin 5
  Uniprot ID: Q6U736
  ENST ID: ENST00000371211
  CDS Start-End: 29-1093
ttcagatccctcgtggttcgagaacagaatggcgttaaatcacactgccctgcctcaggacgagcgcctgccccattaccttcgagatggggatccttttgcttccaaactttcttgggaagcggatttagtggctggcttttacctaacaataattgggattctgtccacatttggaaatggatatgtcctttacatgtcttctagacgaaagaagaagctgagacccgctgaaataatgactatcaatttagcagtctgtgatctggggatttcagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatggggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagagtgggaataacaaatgttctggttgtgaagagtgcatctgaagtgcttacacggcgtctggcatatgcagagaaattagcttacaaatgttatttttctgacttctcgcctccactccacttaccctgtcaggaaaaaataattcacaaggaatatcaaaacaatgatgcaccctaggagtatccaagtatcttaactgagttatctcattctggtatagtggcagagttataactaaagagtgccagaaacccacgctttaaacatcctgcagtgcacacctcggtctcgtcagtaaggacttcactttcttctgaactggggcttgtgaaagctggcctgaaaagcctgattcaaggagatcaggctgtgtctctgactggagcagctacactccccatctgtaatttgatttgttctattgcagatgatgtactgggcagaggtgagtgtggattggtgaaaatctgtttttatgactggcaaagcagtgcaggggggtctttcactgataagaagcatcatcagtagggtttgtccctgatgcctttacaacagcatctgagcacctctcaagtttttccaggccagctccagtttcagtgaggagagtgtgggctttctattccccaaatattcttactacagttaatatgtaggttactgccccagcccaactgcaggttcccagatgtgagttccatgtaggcagaaactg

SEQ ID NO: 162641 - DNA, 1142 bp, Homo sapiens
  Payload ID: 12045
  Gene Symbol: OPN5
  Gene Name: opsin 5
  ENST ID: ENST00000393699
  CDS Start-End: 1-1062
atggcgttaaatcacactgccctgcctcaggacgagcgcctgccccattaccttcgagatggggatccttttgcttccaaactttcttgggaagcggatttagtggctggcttttacctaacaataattgggattctgtccacatttggaaatggatatgtcctttacatgtcttctagacgaaagaagaagctgagacccgctgaaataatgactatcaatttagcagtctgtgatctggggatttcagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatggggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagaggtatgaagatggatacagcatcactatggacactcgtattcacttatttgcctcttcactgctgtaaacatttgattgtggccaca

SEQ ID NO: 162642 - DNA, 1931 bp, Homo sapiens
  Payload ID: 12045
  Gene Symbol: OPN5
  Gene Name: opsin 5
  ENST ID: ENST00000489301
  CDS Start-End: 86-1234
tatgaaatggttcaagctggcttattcaggtctgctgagatctctactggtttgcttttcagatccctcgtggttcgagaacagaatggcgttaaatcacactgccctgcctcaggacgagcgcctgccccattaccttcgagatggggatccttttgcttccaaactttcttgggaagcggatttagtggctggcttttacctaacaataattgggattctgtccacatttggaaatggatatgtcctttacatgtcttctagacgaaagaagaagctgagacccgctgaaataatgactatcaatttagcagtctgtgatctggggatttcagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatggggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagagggcaggaacaaatctgctagtcccaataatctggatgcagacagtcatagtaatgatgatgactgtggtaagaaatatgaacctatattctgaggccaagaaacctcttacctgttcaccagggcttcagaaatgaatggcaaactccaatatattttttgaaatgcagaaaataatttagagtattatttgtatttggcttttaaacttgagaaaatacacagccaatgccaactgaagtgttatcgaagtttaatcatgagtatgtaacatatatcagctactccctcttcaatcttcacagatttttgtaaaatagtgacccaagatggaaaggatattctaagcaatgggaaggcaaagagtcgcttaagcttttcattcattgtgatagcaactgaacttcttaatgtatttattgttataaaaatgtgcttgaaaccaccaattattttttcctgtagatggttagaacttttaatattgtctgggaaacttctagaagcataatttgtcaagtcaacctgcatacagcatttgtaagtactctctatgagaacactcagaaaatgttacagtttctgactcattctctctagcccagttgtgtgttaaactgaaggacacacttgactattgcactaggaaaaatgggttaggttctttttatctctgtcagtttccctttatccacacatttaaaataatttctctcttttctttttaagtcacagctgtgttattcaagtgcacttttttttttcaataaagaaaatatactgcattggca

SEQ ID NO: 162643 - DNA, 6381 bp, Homo sapiens
  Payload ID: 12046
  Gene Symbol: OPA1
  Gene Name: optic atrophy 1 (autosomal dominant)
  ENST ID: ENST00000361828
  CDS Start-End: 235-3171
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggtcacaaattggttagtgaagtcataggagcttctgacctacttctcttgttaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 162644 - DNA, 6439 bp, Homo sapiens
  Payload ID: 12046
  Gene Symbol: OPA1
  Gene Name: optic atrophy 1 (autosomal dominant)
  Uniprot ID: O60313
  ENST ID: ENST00000361908
  CDS Start-End: 235-3228
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 162645 - DNA, 6330 bp, Homo sapiens
  Payload ID: 12046
  Gene Symbol: OPA1
  Gene Name: optic atrophy 1 (autosomal dominant)
  ENST ID: ENST00000361150
  CDS Start-End: 235-3120
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 162646 - DNA, 6384 bp, Homo sapiens
  Payload ID: 12046
  Gene Symbol: OPA1
  Gene Name: optic atrophy 1 (autosomal dominant)
  ENST ID: ENST00000361715
  CDS Start-End: 235-3174
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggtcacaaattggttagtgaagtcataggagcttctgacctacttctcttgttaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 162647 - DNA, 6492 bp, Homo sapiens
  Payload ID: 12046
  Gene Symbol: OPA1
  Gene Name: optic atrophy 1 (autosomal dominant)
  ENST ID: ENST00000361510
  CDS Start-End: 235-3282
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggtcacaaattggttagtgaagtcataggagcttctgacctacttctcttgttaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 162648 - DNA, 757 bp, Homo sapiens
  Payload ID: 12046
  Gene Symbol: OPA1
  Gene Name: optic atrophy 1 (autosomal dominant)
  ENST ID: ENST00000392436
  CDS Start-End: 27-757
gcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggtcacaaattggttagtgaagtcataggagcttctgacctacttctcttgttaggttctccggaagaaacggcgtttagagcaacagatcgtggatctgaaagtgacaagcattttagaaagggtctgcttggtgagctcattctcttacaacaacaaattcaagagcatgaaga

SEQ ID NO: 162649 - DNA, 631 bp, Homo sapiens
  Payload ID: 12046
  Gene Symbol: OPA1
  Gene Name: optic atrophy 1 (autosomal dominant)
  ENST ID: ENST00000392437
  CDS Start-End: 132-631
ggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggttctccggaagaaacggcgtttagagcaacagatcgtggatctgaaagtga

SEQ ID NO: 162650 - DNA, 6340 bp, Homo sapiens
  Payload ID: 12046
  Gene Symbol: OPA1
  Gene Name: optic atrophy 1 (autosomal dominant)
  Uniprot ID: O60313
  ENST ID: ENST00000392438
  CDS Start-End: 235-3117
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttcactttgctgccaa

SEQ ID NO: 162651 - DNA, 1096 bp, Homo sapiens
  Payload ID: 12046
  Gene Symbol: OPA1
  Gene Name: optic atrophy 1 (autosomal dominant)
  ENST ID: ENST00000445863
  CDS Start-End: 1-552
cttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaaaaagttacaaggaactgggctgagcacggtggctcacgcttgtaatcccagcactttgggaggccaagatgggtggaaaacaagaaatgttctttttccccagctcggactcaacactacacaccaggccaccacatggcgccgcacccagcattgacacttcttttaccttgtctgggctctgacatccgtgccaggttgctcttcgtcatggagtcccttttactgagctctgctctgacgctttgtgccaggtgcctctccatctcatccttcccacccgctagcctctgcccgaccccagacagattccttcctcacctgaagccagaccatgcctttgtggagataccctctttaccctgcctgtgcttcgccagcctgcaccaggccaccctcctgcacagatactctcctcagtactggaccaggctaccaacagccccatgtgaacccattgtaacccaggtcaggcattaacacctgcagtaggctaccatggcttccccttcccacccccctagcttggccctactaataatcactttgtcactgtttggggttgatatttggttgtttcttgtaggttcctagctttaagataggattgcatactaaaatttacttagatctttgagaactcaaggaaatcagtgaaacattattgttattaaataaaaataaaatacctgtagttggta

SEQ ID NO: 162652 - DNA, 780 bp, Homo sapiens
  Payload ID: 12046
  Gene Symbol: OPA1
  Gene Name: optic atrophy 1 (autosomal dominant)
  ENST ID: ENST00000419435
  CDS Start-End: 528-780
cttcctgggtcattcctggaccgggagccgggctggggctcacacgggggctcccgcgtggccgtctcggcgcctgcgtgacctccccgccggcgggatgtggcgactacgtcgggccgctgtggcctggatagcagaaaggagctcatctgtttggagtccatttttgatggggatcccactagagtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagg

SEQ ID NO: 162653 - DNA, 554 bp, Homo sapiens
  Payload ID: 12046
  Gene Symbol: OPA1
  Gene Name: optic atrophy 1 (autosomal dominant)
  ENST ID: ENST00000434811
  CDS Start-End: 1-554
gctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggtcacaaattggttagtgaagtcataggagcttctgacctacttctcttgttaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatg

SEQ ID NO: 162654 - DNA, 393 bp, Homo sapiens
  Payload ID: 12046
  Gene Symbol: OPA1
  Gene Name: optic atrophy 1 (autosomal dominant)
  ENST ID: ENST00000429164
  CDS Start-End: 1-393
gattagagaaaaatgttaaagaggtattggaagattttgctgaagatggtgagaagaagattaaattgcttactggtaaacgcgttcaactggcggaagacctcactcggactcaacactacacaccaggccaccacatggcgccgcacccagcattgacacttcttttaccttgtctgggctctgacatccgtgccaggttgctcttcgtcatggagtcccttttactgagctctgctctgacgctttgtgccaggtgcctctccatctcatccttcccacccgctagcctctgcccgaccccagacagattccttcctcacctgaagccagaccatgcctttgtggagataccctctttaccctgcctgtgcttcgccagcctgcaccagg

SEQ ID NO: 162655 - DNA, 7828 bp, Homo sapiens
  Payload ID: 12047
  Gene Symbol: OPA3
  Gene Name: optic atrophy 3 (autosomal recessive, with chorea and spastic paraplegia)
  Uniprot ID: Q9H6K4
  ENST ID: ENST00000263275
  CDS Start-End: 56-595
gttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtatcactgggtggagatgcggaccaagatgcgcatcatgggcttccggggcacggtcatcaagccgctgaacgaggaggcggcagctgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccgttacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctcaaaaaaaaaaaaaaaatcctggctgggcacggtggctcacacctgcaatcccagcactttggaaggtcgaggtgggcgggtcatttgaagtcgggaggtcgggagatcgggagctcgagaccagcctgaccaatatgatgaaaccccgtctctactaaaaatacataaattagctgggcatggtggcatgcacctgtaatcccagctacttgggaggctgagacaggagaattgcttgaacccgggaggcagaggttgcagtgagccgagattgcgcaattgcatgccagcctgggtaacgagcaaaactccatcttaaaaaaacccacaaaaggtcctggcctgcagtcaatccctggaatcattgtaccttcccttgagacccgaagtggactattccaacagaaccccctcatccttgagtctatggcacaacccactggaatggcactacaggatcttttctgtgaatgtcctccaacccccctttccgtggtgggaaatttgatcctaactagggctaatccagcctgtccttcagcctcagccccctattttcctgtcctcagagtccctggagcttgtactgtgtggcatgtcctttcttgccttccccaccttgctcagtagcatttctcagggacccagtcgaatccaagcccatggattcaattgtcacatccttcatcttccatccgtgtctcctaatctgtgtgctcttgctttctttcctcggagctctggactgacccgacagcctgtcttcatgtagcagtaccctcctgcctccatagcccccggtcccacccccatcctaccaattaggccagcagttggccttaactgcttgattaatttccttggactgccataacagatcaccattgggtggtgaacttgatggcttaagtccaacaggaatttaattcacacagttctggagtccagaagtctgaaaccaaggtgctgacagggacacgctccctcttccagctcctggtgattccaggccttccttggctctgcctgcagcttcacatggccttttccctcttctattttgtctcttacaagaacacctgtcattgcatttagggcccatcttaagttcaggatgatcccacctcaagacccttaattacatctgaaaaaacactttttccaaataaactgtcataagcacaggtcctgggggttagtatgtggacttgtctgttgggggcacaccattcaagccattcagcccactattcctcctcaccccaagagtacgctggcgtccaggtgcagtggctcacacctgtaatcccagcactttgggagaccagggcaggagggatctctttgagcccaggagctgaagaccagcctgggcaacatagtgagaccccatctctacaaaagtaaaataaaaaattagccaggtgcggtgatgcatgcctgtagtcccagctacttgggaggctgaggcaggaggatcacctgagccctggaggtcgaggctgcagcgagccgtgatcgcgccactacactccagcctggatgacagagtgagaccctttctcagaaaaaaagtaccctgggactcctgccaaccccgcgggccatttggccttcctgctagctgagaggaacagtctaggaaccacccttttctactgggtttctcttccaggatctgccactgaagcgggagggggtgggtcccagtagcctgcagtctgtccttccgactgtagctctctcattagaggagctgcaaggtgatgaaggcatcctgaggctgtacctgaaccaccatgtggatctccacaatgggtacagagcttattaaaatcaggagggaaactgggagggttctgatggggagaggcccaagagtcaccctatgagctggggaaactaaggccaggggtaagcaaagggacttgccagagatgccacagccagtgaggggctgactgcccagggtggtgaagtagtaggggcagagtgagaggcttggattaccccagctgcagagtgaggagggagaggcgatggctgagcagaggctgggagggtgacgatctctacacagaggcccagaccatcccagaggtggcgttgatagtgggagaccctctctatcccctctcagagcagccccagatcacaccagagatcatagcattgtgtaaactgggtgaccattccacctgggcccgcttttgggaagctgcaggtgaaagtgggagggccgggctttccccgacttccatcctcacctcccttctctaaagaggtaaaactggcctggaccaagatctgcccagatagaaagccaagaaacaggttctgaaacttttcttttcttcttttctcttcttttttcttttcttttctttcggagacagtctagctccgtcaccctgacggagtgcagtggtgcaatctcggctcactgcaacttctacctcccaggctcaaccaatgatcctgcctcagcttccgaagtagctgggattacatgtgcccaccacccacgcctggctaatttttgtattttagtggagacggggtttctccaagttgcccaggctgatcttgaactcctgacctcaggtaatccgcccgcctcggcctcccaaagtgctgggattacaggcgtgagccaccgcgcctggcctgaaacagcatttcagttccttctggaagagggggagaagctggagcagagggaactgaccgagtgggtcctgagtgggctgtgtttaaaactgggagtgacccaggccagctcacgcctgtcatcccagcactttgagaggccaaggtggactgatcacatgatgttaggagatcgagaccagcctggccaacatggcaaaaccccgtctctactaaaaatacaaaaattagccgggcatgttggcacattcctgaatcccagctactcgggaggctgaggcacgagaattgcttgaacccaggaggtggaggttgcagtgagctgagatcgcgccactgcactccagcctgggtgacagagtgagactcaactcaaaaaaaaaaaacagaggtgggagtgtgaacacaggcaggagctccaattcctgaccccagcgctgtcctgacccagatggagtgctgctctcacatctcagagacttcgcactcagccctgccctgccctgccctgacaggcagccagtcatcgtgggcagcagggccatctacttcccccactgcggcgtcaggggtggccagagtgtgtggaagtggaaagaacgtcctctcaaaatgcaagaggccagaggatggttcactgctcgtgtgttctgctagctagaattctgtgtaccttgtaatttggggagaggggttagaataaatttgtaaatgaagctgattatcttcaagttgatgcattcttttttcatatttaaaaagtccttgggactgggcgcagtggctcacacctgtaatcctagcactttgggaggccagggtgggtggatcacctgaggtcaggagttcaagaccaacctgatcaacatggtgaaacctcgtctctactaaaaatacaaaaattagctgggcatggtggttgtgcacctgtaatcccacctactcgggaggctgaggcaggagaatctcttggacccgggaggcggaggttgcagtgagccgagatcatgccattatactccagcctgggtgacagagcgagacttcatctctaaataaataaataaataaataaataaataaggtccatgtcaaccttaggaaaaatatcctttatttattctttcactcaaaaaactcactgaggtggtcccgcaccgggacatggacccagtgtccttggtagggcgtctcccgcaaaaaaaaaaaaaataaaaaaaataaaacacaaaactcactgagttacccactctctgccccaccctatgctggggtcacagtggtgacagagacagccccagccctgccgtcaccgggtcttacagatgctcacacgtacatttcttttccagtgttccctgccccaccccatagttgtttaggaagcaggggctgggctgaatccggaatcctccctctggagtgactcaggactataaacccattcatcccagctcacaaaaccctgggaggtgccctgagggctgtgcccctcccatctcctggcaggccctgctgtccctcttgttggtttctctgtagggcaggccattgcctggagggaggcaaaatggctgagagccaccccaggagaaaatgggctttacataagccccaacctgatctattggctcacggagctactcctgggctggtcgctgtgttgctgagtggcaggcttgggtcccccagtggcaatggcttgtagctggagtcggtgtggacagagagaggagaagcatggcaactctgagtgtactgaggatcaactgcaccaggctccattctagtagctgggagccagttgggagcaagcagaggccctcactggagctgacattctagtgccagagaccggcaataaagaaggaaagagtggccaggcgtggtggctcacacctgtaatctcagcactttgggaggccgaggcgggccaatcccctgaggtcgggagttcgagaccagcctgaccgacatggagaaaccccatctctactaaaaatacaaaattagcagggcatggtggtgcatgcctgtaatcccagccactcaggaggctgtggcaggagaatcgcttgaacccgggaggcggaggttgcggtgagccaatattgcaccattgcactccagcctgggcaacaagaacgagactccatctcaaaaaaaaaaggaaaaagctaatccagcatagggtgatgaggactgagaggaatggaggcagggtaggagttccggacttacgggcaccgctgatctagacaggtgggcagggaggaggcagcgcttcagatggagggagataggaagagggctgtgagtatctgtgaaagtcctaggacagatgtggccttggcctgttcctggaacagcaagagtttctggctgtcagaatagagcagaggctcgctgaccaaggcctttgggccaaatcaaggggacccttgcttcctgtctttgtaaataaagacttattggaacccaggcgctcattcgtttgcatattttccacagttgcttttgcagtacagtgacagagctgagtatttgcacagagatcctagggctctcgtactctctggccctttacagaaaaagtttaccatcccctggaatagagtaagcgaggggagaagttaggtgagggggccaggcaagcaaaggctgccccttgccttgattggcacaactgtggaggtcatcccagctctggagccccaacaggatcactcaggcctctgcttccaccacatctggcttcagcttccccctctgtggagtcctccctccctccctccttccccataggaaatgaccccagtgctcagcagtaacccccactgcgcgcagatctcagaacctccacctcaatctacagccacgtgccacaataagaagcagagttttaggccaggcgcggtggctcacgcctgtaatctcagtactttggaagaccaaggtgggaggatcacttgaagtcaggagttcgagaccagcctgcccaacatggtgaagccccgtctctaataaaaagaatacaaaaattagccgggtgtggtggtgcacatctgtaatcccagctacatgagaggctgacataggagaattgcttgagcccaggaggtggacgttgcagtgagccaagattgcactactgcattccagcctaggtgccagagtgagacttggtctcaaaacaaaacaaaacaaaaaattagccaggcatggtggcacacacctgtagtcccagctacttggggggctgaggcaggaggatcgcttgaacccgggtgtttaaggctgcagtgaactgagatcaggccacagcacctcaacctgggagacaaagtgagaccctgtctcaaaaaaaaaaaaaagcagagtttatgtaatccatcgtgtgcatatttatacaataatttacaattctatgtattttaaaagtgtataattcatatattatgtgacacaatatataatggaatataaaatatatattttatgtcatgtgtaacataacatcatctattatatgtagtgtatgtgcttatgtacatatcattggaatgaaagtttcattaaataattacccttaa

SEQ ID NO: 162656 - DNA, 2250 bp, Homo sapiens
  Payload ID: 12047
  Gene Symbol: OPA3
  Gene Name: optic atrophy 3 (autosomal recessive, with chorea and spastic paraplegia)
  Uniprot ID: Q9H6K4
  ENST ID: ENST00000323060
  CDS Start-End: 79-621
gagggcgggggaggagtgaagaggttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtaccactggctggagatgcggaccaaaatgcgcatcatgggtttcaatgccgctgccatcaagccgctgaacgagggtgcagccgccgagctgggcgcggagctgctgggcgagggcatcatcttcatcaccgcctgcagctgcctgatgctggagtattggcgccaccagttgcagcagcgccgcaaggaaaaggagcgacgtgttgccagggaggcgctgcggggcgaggtgggccacttggggctggcgctcgaggagttgcaggcgcaggtgcaggcgacgtcgacgcagctcgccctggaggagctgcgcgctcagctgcaggaggtgcgagcccacctctgcctccgagacccgccgcctgcacccccagttgcgccggcgtccgagaaataggaggtctcggggccctggtcttggaggtgactgctgtctggactgcgaagtctctgtcttggcctattctccgcactgtcccatcctggaccggcccagctgacaccacccagtccttcgggggcgccggagagatcctgggctggagctgatcgaacctccctactaacctgcccagtggtaccttccactgggactctccgcctcctgcaggtggaacgttccaagaaggaccccgccctatcccaccccgcccctgccagcgcatttgttgagcactttggaaagacagcgtcttttatcagaccccacctccctaccgctaggtaggccagcaggacgtccacctcttttggcaaaacaaaattctgcacccggatttagccacctctcattctgtcacccgcaccctcactcacctgagtggacccttcccctaggacgctcatcctttgcaccgaacaccacctacctcctcctcattggtacagaccattgtaaagatgcacaaagttcctacggacttcccgacccgcccccttccatctacctcagtcttagggggaaaggtgggggtgaatcctggactgcgttagctccaatgagtcaccaccctgcggctcctgaccttaatccatcttagtacctgtcattgacatcctcccctccctgagtggatcgatccaacataacccccctcttcttccacctatggcgcaccccactggcatggctatgctgggtcttccagggaaacgcctcccagcccggcattctgtggtctgttccagcaggacgtggccttttgggaggaaaaaccggtcttgaccagggctagtccattctggctttcaggctcagtcacttggtcaccagtccccagtcctggacctactgctactgtccttttatccggtcctccctcgctgtcctcttcagttgcctttgctagggaccggcctgtccctttactacctaagtcatcgtcagttcgcccaacttccctccaaatctgcccctcacggtacgcagggatcgcccttccttcctgcctttggactggtccaggtcctcctccgccctccttcacgcaaaggcctcctccagggggactacctgtccctcagcccagaggtccccctgtccaagcggggtattccaccaggccatatgacctacccacccgacaactgaagggggcgtggatgagctctgtgactctgaatgctactttataaatcgactgtcagcgttttctaattaaaggagctctggggtaaagatcttaagaacgtgtctgagaaccataatgtgcgtctgcaaaatgtcattgaaattaggaaagaaggccggacacagtggctcacgcctgtaattccagcactttaagaggccaaagcaggaggactgctggaggccaggagttagagaccaacctaggcaacacagcaagaccgcatctctacgaaaaatgaaaatattagctaggcgtcataccaaacgcctgtagttccagctacttgggaggctgaggcaggaggatcccttgagcccaggagttcaaggctgcagtgagctgtgatcctgccactacactccagactgggtgaaagagcaagactccaactc

SEQ ID NO: 162657 - DNA, 1146 bp, Homo sapiens
  Payload ID: 12047
  Gene Symbol: OPA3
  Gene Name: optic atrophy 3 (autosomal recessive, with chorea and spastic paraplegia)
  ENST ID: ENST00000544371
  CDS Start-End: 136-516
agccgctgttctgccccgcgggggcatccgctgggtccccgcgccgttgtcaagaccggggacctggacgcagcggagagaggtgccgccgcccgccccgtccagtcgccgcgcgcagtgtatcactgggtggagatgcggaccaagatgcgcatcatgggcttccggggcacggtcatcaagccgctgaacgaggaggcggcagctgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccgttacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctg

SEQ ID NO: 162658 - DNA, 1359 bp, Homo sapiens
  Payload ID: 12048
  Gene Symbol: OPTC
  Gene Name: opticin
  Uniprot ID: Q9UBM4
  ENST ID: ENST00000367222
  CDS Start-End: 117-1115
gacagcctccaccagagtccccacctttctggaagctgcagggctctccatccaggatccagaagcattgaaggggaccagccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatggtctgcccacctgcctggtctgcgtgtgcctcggttcctctgtgtattgcgatgacattgacctagaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgccttccgcctgctacatgccctccaggacctcatcctcccagagaaccagttggaagctctgcccgtgctgcccagtggcattgagttcctggatgtccgcctaaatcggctccagagctcggggatacagcctgcagccttcagggcaatggagaagctgcagttcctttacctgtcagacaacctgctggattctatcccggggcctttgcccctgagcctgcgctctgtacacctgcagaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtggccgccggcagcatggacaaaggtctccatgcagggggaggaggcctgcttctttccccacagctctcacgtctcccttctccctgcgggtgacaaagaagcccaaggaccacctccttcctgcctcattgtaataaaattccccacactga

SEQ ID NO: 162659 - DNA, 560 bp, Homo sapiens
  Payload ID: 12048
  Gene Symbol: OPTC
  Gene Name: opticin
  ENST ID: ENST00000448911
  CDS Start-End: 37-560
gccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatgaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgcctt

SEQ ID NO: 162660 - DNA, 2464 bp, Homo sapiens
  Payload ID: 12049
  Gene Symbol: OPTN
  Gene Name: optineurin
  Uniprot ID: Q96CV9
  ENST ID: ENST00000263036
  CDS Start-End: 674-2407
atccctgcagcgctacccgggtactctggatgcacatagggcggctctcgctcctaccttgtcatcctgctgtctaatccgggggcagcttccctcctccacaccagcagaggctattcttcagcaacaagaatagccgagcctattcgtccgcaacaagagcccaagaagcatcctgcaggctttctgctttttgagtgtattttaaagcaaaaacgagtggaaagctatgtatgctcagttaactatgtctagatgttaaccttttttcaaaaaacacagatggaggcctccctccgaggatgcctggcattctcctctttctgtgggcggcagcgaccccctgcggctccagcctccactacgggatctgcgggaagacacggggaagacgaactccgcacactgcatttgattaatgatttattttgattaacgccgtcacagtgacgccttagagcagtccctgttcacccgggtcccagcctcgaccccgcacggacagcgagggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaag

SEQ ID NO: 162661 - DNA, 3400 bp, Homo sapiens
  Payload ID: 12049
  Gene Symbol: OPTN
  Gene Name: optineurin
  Uniprot ID: Q96CV9
  ENST ID: ENST00000378747
  CDS Start-End: 242-1975
atcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 162662 - DNA, 3521 bp, Homo sapiens
  Payload ID: 12049
  Gene Symbol: OPTN
  Gene Name: optineurin
  Uniprot ID: Q96CV9
  ENST ID: ENST00000378748
  CDS Start-End: 363-2096
gccccctccgccaccgccgccgcccgccggcaggttccctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttggagtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 162663 - DNA, 3488 bp, Homo sapiens
  Payload ID: 12049
  Gene Symbol: OPTN
  Gene Name: optineurin
  Uniprot ID: Q96CV9
  ENST ID: ENST00000378752
  CDS Start-End: 348-2063
gccccctccgccaccgccgccgcccgccggcaggttccctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttggagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 162664 - DNA, 3321 bp, Homo sapiens
  Payload ID: 12049
  Gene Symbol: OPTN
  Gene Name: optineurin
  Uniprot ID: Q96CV9
  ENST ID: ENST00000378757
  CDS Start-End: 146-1879
ggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaa

SEQ ID NO: 162665 - DNA, 2498 bp, Homo sapiens
  Payload ID: 12049
  Gene Symbol: OPTN
  Gene Name: optineurin
  Uniprot ID: Q96CV9
  ENST ID: ENST00000378764
  CDS Start-End: 520-2235
aacaagagcccaagaagcatcctgcaggctttctgctttttgagtgtattttaaagcaaaaacgagtggaaagctatgtatgctcagttaactatgtctagatgttaaccttttttcaaaaaacacagatggaggcctccctccgaggatgcctggcattctcctctttctgtgggcggcagcgaccccctgcggctccagcctccactacgggatctgcgggaagacacggggaagacgaactccgcacactgcatttgattaatgatttattttgattaacgccgtcacagtgacgccttagagcagtccctgttcacccgggtcccagcctcgaccccgcacggacagcgagggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaa

SEQ ID NO: 162666 - DNA, 664 bp, Homo sapiens
  Payload ID: 12049
  Gene Symbol: OPTN
  Gene Name: optineurin
  ENST ID: ENST00000424614
  CDS Start-End: 1-380
aaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactacagggtttcaccatgttggccaggatggtcttgatctcttgacctcgtgatcctcccacctcggcctcccagagtgctgggattacagatatgagccactgcgcccagctgcaagatgtatttctatcagtattctacaaaacgatttcctatgtctcttcttgactgatttcttctcctcggtccttcaatgaacaagcctactgtaggaaaaggaatgttgtccactttataatgagatcatttgaggatatgacttagaaacttgagggagaattgaaagatttgggttctatcccattactggtttgaataaagtagtttgaaaggaaaa

SEQ ID NO: 162667 - DNA, 848 bp, Homo sapiens
  Payload ID: 12049
  Gene Symbol: OPTN
  Gene Name: optineurin
  ENST ID: ENST00000430081
  CDS Start-End: 142-330
gccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagagccatgtggtcaagtggactagagggagatttggttcatcagatcaagtccactttcctggtgtgtgactccatcactctgaacctcctgcagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacag

SEQ ID NO: 162668 - DNA, 423 bp, Homo sapiens
  Payload ID: 12049
  Gene Symbol: OPTN
  Gene Name: optineurin
  ENST ID: ENST00000486862
  CDS Start-End: 1-323
aagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgtatgtgaaggaagactcgggctgtcaggcagacaggctgggcaggctcgtcactgggtgcttgtcaccggaggtcaaatgttgtgacctgaggaagtaacttctttatgatttataccaggatctttccagaatatttggtttgaatgctatttaatgttgcagctcaaactggcaaagattaaaaactgtttggttcc

SEQ ID NO: 162669 - DNA, 667 bp, Homo sapiens
  Payload ID: 12049
  Gene Symbol: OPTN
  Gene Name: optineurin
  ENST ID: ENST00000482140
  CDS Start-End: 152-328
agtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcct

SEQ ID NO: 162670 - DNA, 957 bp, Homo sapiens; identical to SEQ ID NO: 161903
  Payload ID: 12050
  Gene Symbol:
  Gene Name: OR1B1
  ENST ID: ENST00000624439
  CDS Start-End: 1-957

SEQ ID NO: 162671 - DNA, 995 bp, Homo sapiens
  Payload ID: 12050
  Gene Symbol:
  Gene Name: OR1B1
  ENST ID: ENST00000623530
  CDS Start-End: 39-995
tgacttaaactgtctttcaggcaggctgactgtcactcatgatgagctttgcccctaatgcttcacactctccggtttttttgctccttgggttctcgagagctaacatctcctacactctcctcttcttcctgttcctggctatttacctgaccaccatactggggaatgtgacactggtgctgctcatctcctgggactccagactgcactcacccatgtattatctgcttcgtggcctctctgtgatagacatggggctatccacagttacactgccccagttgctggcccatttggtctctcattacccaaccattcctgctgcccgctgcttggctcagttctttttcttctatgcatttggggttacagatacacttgtcattgctgtcatggctctggatcgctatgtggccatctgtgaccccctgcactatgctttggtaatgaatcaccaacggtgtgcctgcttactagccttgagctgggtggtgtccatactgcacaccatgttgcgtgtgggactcgtcctgcctctttgctggactggggatgctgggggcaacgttaaccttcctcacttcttttgtgaccaccggccacttctgcgagcctcttgttctgacatacattctaatgagctggccatattctttgagggtggcttccttatgctgggcccctgtgccctcattgtactctcttatgtccgaattggggccgctattctacgtttgccttcagctgctggtcgccgccgagcagtctccacctgtggatcccacctcaccatggttggtttcctctacggcaccatcatttgtgtctacttccagcctcccttccagaactctcagtatcaggacatggtggcttcagtaatgtatactgccattacacctttggccaacccatttgtgtatagcctccacaataaggatgtcaagggtgcactctgcaggctgcttgaatgggtgaaggtagacccctga

SEQ ID NO: 162672 - DNA, 939 bp, Homo sapiens; identical to SEQ ID NO: 162177
  Payload ID: 12051
  Gene Symbol:
  Gene Name: OR2L8
  ENST ID: ENST00000623922
  CDS Start-End: 1-939

SEQ ID NO: 162673 - DNA, 1107 bp, Homo sapiens
  Payload ID: 12052
  Gene Symbol:
  Gene Name: OR51G1
  ENST ID: ENST00000624469
  CDS Start-End: 69-1034
ttcagccttgtcactttccaggaatctcattctatattccaggtttctgagtccaagattgtaaagctatgacaattcttcttaatagcagcctccaaagagccactttcttcctgacgggcttccaaggtctagaaggtctccatggctggatctctattcccttctgcttcatctacctgacagttatcttggggaacctcaccattctccacgtcatttgtactgatgccactctccatggacccatgtactatttcttgggcatgctagctgtcacagacttaggcctttgcctttccacactgcccactgtgctgggcattttctggtttgataccagagagattggcatccctgcctgtttcactcagctcttcttcatccacaccttgtcttcaatggagtcatcagttctgttatccatgtccattgaccgctacgtggccgtctgcaacccactgcatgactccaccgtcctgacacctgcatgtattgtcaagatggggctaagctcagtgcttagaagtgctctcctcatcctccccttgccattcctcctgaagcgcttccaatactgccactcccatgtgctggctcatgcttattgtcttcacctggagatcatgaagctggcctgctctagcatcattgtcaatcacatctatgggctctttgttgtggcctgcaccgtgggtgtggactccctgctcatctttctctcatacgccctcatccttcgcaccgtgctcagcattgcctcccaccaggagcgactccgagccctcaacacctgtgtctctcatatctgtgctgtactgctcttctacatccccatgattggcttgtctcttgtgcatcgctttggtgaacatctgccccgcgttgtacacctcttcatgtcctatgtgtatctgctggtaccaccccttatgaaccccatcatctacagcatcaagaccaagcaaattcgccagcgcatcattaagaagtttcagtttataaagtcacttaggtgtttttggaaggattaagttagagtaaagagaggaagttttggacataaagcccacaggtttctgtttgttttcagctgtgctgtggcaa

SEQ ID NO: 162674 - DNA, 966 bp, Homo sapiens; identical to SEQ ID NO: 162382
  Payload ID: 12052
  Gene Symbol:
  Gene Name: OR51G1
  ENST ID: ENST00000623849
  CDS Start-End: 1-966

SEQ ID NO: 162675 - DNA, 926 bp, Homo sapiens
  Payload ID: 12053
  Gene Symbol:
  Gene Name: OR52E1
  ENST ID: ENST00000445557
  CDS Start-End: 1-926
atgaataccactctatttcatccttactctttccttcttctgggaattcctgggctggaaagtatgcatctctgggttggttttcctttctttgctgtgttcctgacagctgtccttgggaatatcaccatcctttttgtgattcagactgacagtagtctccatcatcccatgttctacttcctggccattctgtcatctattgacccgggcctgtctacatccaccatccctaaaatgcttggcaccttctggtttaccctgagagaaatctcctttgaaggatgccttacccagatgttcttcatccacctgtgcactggcatggaatcagctgtgcttgtggccatggcctatgattgctatgtggccatctgtgaccctctttgctacacgttggtgctgacaaacaaggtggtgtcagttatggcactggccatctttctgagacccttagtctttgtcataccctttgttctatttatcctaaggcttccattttgtggacaccaaattattcctcatacttacggtgagcacatgggcattgcccgcctgtcttgtgccagcatcagggttaacatcatctatggcttatgtgccatctctatcctggtctttgacatcatagcaattgtcatttcctatgtacagatcctttgtgctgtatttctactctcttcacatgatgcacgactcaaggcattcagcacctgtggctctcatgtgtgtgtcatgttgactttctatatgcctgcatttttctcattcatgaccataggtttggtcggaatatacctcactttatccacattcttctggctaatttctatgtagtcattccacctgctctcaactctgtaatttatggtgtcagaaccaaacagattagagcacaagtgctgaaaatgtttttcaataaataa

SEQ ID NO: 162676 - DNA, 985 bp, Homo sapiens
  Payload ID: 12054
  Gene Symbol:
  Gene Name: OR5AL1
  ENST ID: ENST00000440231
  CDS Start-End: 1-985
atgtgtgctctaaagggttttctggaagaaaacttttatacctactcagtggccaaaggcaatcattcaacagtgtatgaatttatcctcttggggctcacagataatgcagagcttcaagtcactctctttggtatattccttgtagtatacttagctagctttatgggtaatttcggtttgattatgctaattcaaatcagtcctcagcttcatacacccatgtattttttcctcagccatctggcttttgttgatttttcttttacttcatctgttgccccaaataccttggtaaattttctgtgtgaagttaaaagtataacattttatgcatgtgccattcaggtatgctgcttcatcacatttgtagtttgtgaattatatttgctctcaatcatggcatatgatcggtatgttgccatctgtaaccctttactttatgtcattctcattcctagaaaactgtattaaactgattgctagcacgtatgtgtatggattcactgtgggacttgtacagacagtggcgacatcctacttgtctttttgtgattccaacgtgatcaaccacttctaccatgatgatgttccattagtggctctggcctgttctgacactcatgtcaaagagctgatgttgttaatcattgctgggttcaatactctctgctctctagtaattgtgctgatttcttatggtttcattttctttgccatcctgaggatacattctgctgaagggagacagaaagcattttctaccagtgcttcccatctgacctccatcacaatattttatggaacaatcatttttatgtacccgcagcccaagtcaagccattccctgaatatggataaagttgcttctgtgtttaatgtggtagtgattcctacattaaacccactgatctatagtttaagaaatcaggaggtaaaaaatgcactaaagagaattatagaaaagttatgtttggctgtcaaa

SEQ ID NO: 162677 - DNA, 945 bp, Homo sapiens; identical to SEQ ID NO: 162309
  Payload ID: 12055
  Gene Symbol:
  Gene Name: OR5D13
  ENST ID: ENST00000623618
  CDS Start-End: 1-945

SEQ ID NO: 162678 - DNA, 945 bp, Homo sapiens; identical to SEQ ID NO: 162309
  Payload ID: 12055
  Gene Symbol:
  Gene Name: OR5D13
  ENST ID: ENST00000623930
  CDS Start-End: 1-945

SEQ ID NO: 162679 - DNA, 852 bp, Homo sapiens
  Payload ID: 12056
  Gene Symbol: ORAI1
  Gene Name: ORAI calcium release-activated calcium modulator 1
  ENST ID: ENST00000611718
  CDS Start-End: 122-391
gcggcagccgccggagccgccgccgcagcggggacggggagcccccgggggccccgccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtgagctccggccgccctgccctgccccctctactgtcccggctgctcccgcccgcagccccgacggggctctctgggcgggccgggcgggccagagtgaggggaagagctgggagaaaccgtggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataaga

SEQ ID NO: 162680 - DNA, 1496 bp, Homo sapiens
  Payload ID: 12056
  Gene Symbol: ORAI1
  Gene Name: ORAI calcium release-activated calcium modulator 1
  Uniprot ID: Q96D31
  ENST ID: ENST00000616379
  CDS Start-End: 194-1099
gccgcccgggggcttttgccagcggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgcagcagtcccgagcttcccccaagcggcggcagcaccaccagcggcagccgccggagccgccgccgcagcggggacggggagcccccgggggccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagactgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctcc

SEQ ID NO: 162681 - DNA, 2138 bp, Homo sapiens
  Payload ID: 12056
  Gene Symbol: ORAI1
  Gene Name: ORAI calcium release-activated calcium modulator 1
  ENST ID: ENST00000617316
  CDS Start-End: 388-1104
gccgcccgggggcttttgccagcggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgcagcagtcccgagcttcccccaagcggcggcagcaccaccagcggcagccgccggagccgccgccgcagcggggacggggagcccccgggggccccgccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagactgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgtgtcttgtatttgttgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggcgcctgcacttccagctcctttgagagactgaggcaggaagattgcctaagcccaggaggccaagtctgcagtgagctatggtaacaccactgcactccaacctgggcaacagagggagactctgtctctaaaaaaatagaaaaatttgccctgcatggtggctcacgcctgtaatcctagccctttggaaggccaaggcgggcagatcacttgaggtcgggagttcgagaccagcctgaccaacatggagaaaccccatctgtactaaaaatacaaaattagctgggtttggtggcgcatgcttgtaatcccagctactcgggaggctgaggcaggagaatcgcttgaacccaggaggcggaggttgcagtgagctgagatcgcgccattgcactccagcctgggcaacaacagtgaaactccgtctc

SEQ ID NO: 162682 - DNA, 10811 bp, Homo sapiens
  Payload ID: 12057
  Gene Symbol: ORAI2
  Gene Name: ORAI calcium release-activated calcium modulator 2
  Uniprot ID: Q96SN7
  ENST ID: ENST00000356387
  CDS Start-End: 278-1042
gggggaccccgcgcgaccggcggaaggagggagggggccgcgctcggcgccccggccgggccactgggccacaggccacgcggccacgcagtccgagcgggagccgagccgggcggggcgagggcagctccgcgtttctctgaattctccccaagggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggggttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcaagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcctggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctattcaaagtctttctgttcttgggggatgctgtgggcagaggggataaattgcagcccctggccctcccgtggcatctgctgactgggggacccacatcgtggcctgaaaaactcctggagcgccctctggcctcctgtcgctggtcactggccagtgtcctcccaggctgccccggcaagggggcgtggacatctctagaatggaggcagggtactcatgtccagacacgccgccatggggctccgccccgagagcgcagggtgcctctgcctggcgcttcccctcccagacagggccctctctttccagaaacaaaagaaggggcagccccagagggtggctgagcgacaacagagcccacctggacagggtcagcttggcgttccccccagtcccttgaggagaggagctaccagagcactggtcacctcaggacattctccagccccaagtccctgtggggcagcaggaacaggtgggtccctcctgcgggctggtggcactgctaaggaagcaccagacagccttttttttttttttgagacagagtcgctctgtcacccaagctggaatgcggtggcatgatcttggctcactgcaacctcctcctcccaggttcaagcgatcttgtgcctcagcctcccaagtagctgggattacaggcacgcaccaccatgcttggctaatttttgtatttttagtagagacgggggtttcaccatgttggccaggctggtctccaactcatgacctcgtgatctgcccacctcggcctcccaaagtgctgggattacaggtgtgagccagcttgcccagcttatgtttatagatttattttagagacagggttgggctctattgcccaggccagagctggagtgcagtggtgcaatcatagctctctgcaggctccagcttctgggcgcaagcaatcctcccacctcagtctcccaagtagctacacttgggagactacgggcgcacactaccatgcccagctaatgttttttttgtagagatgggatcttgctatgttgcccagtctggtcttgaacttctggcctcaagcgaccctcctgccttggcctcccaaagtgctgggattacaggtgcgagccaccatgcctggcccattctgttttttgtcggccactgaggtagaggccctcttctaggaaagaatttctgtttgttttgttttgttttgttttgtttttttgaaacagtctctctctgtctcccaggctggagtgcagtggcgtgatctcagctcgctgcaacctccacttcccaggttcaagcaattcttctgccaagctgggactacaggcatgcaccaccaccatgccctgctaatttttgttgttgtcgttggtttttgagatagagtttcgctcttgttgcccaggctggagtgcagtggcacgatctcagctcaccgcaacctccgcctcccaggttcaagcaattatcttgcctcagcctcccaagtagctgggattacaggcatgcgccaccacacctggcttatttttgtatttttagtagagatggggtttctccatgttagccaagctggtctcgaactcccgacctcagatgatccgcctgcctcagcctcccaaagtgctggggttacaggtgtgagccaccacacccagcctttctttttgcatttttaatagagactgagtttcatcacactggccaggctggtttcgaactcctggcctcaagtgatccgctggcctcagcctcctaaagtgctggattacaggcatgagccaccgtgccaggccttgttaatatttttaactctggcacttcaccctagaggctgctaggaatcaggtgtgccaagcaactggcaccactccatggaaagcgtctagggcagtgccttggttctgccaatcctgagaagccaggctgccccttgggctgggcagtggcctcagtaccgagccccaggccagcaagcccacaagcctcgagaaagactgcacttccggtggaggctgcagtttccttaaagggaaaatctgccccacccctgtcaagggcaggacacaagtcactggcattgaaggacccactccacacccagcagatcatcgacgcagactttttttttcccagatagagtctcactctgtcgtccaggctggactgcaatggtgtgatcttggctcactgtaacctccgcctcccgggctcaagtgattctcctgcctcagcctcctgagtagctaggattacaggcgcccaccatcacgcctggctaatttttgtatttttagtagagacggggttttgccatgttggccaggctggtcttgaactcctgacctcaagtgatcctcctgcctcagcctcccaaagtgctgggattataggcgtgagccacctcgtccggcccaagactttttgcctcagatgctgcagagccctggtggggcccaggagggcaaggcccacacaggagccgaaacccatgtagaacctgccaacctgtagctcacacctataatcccagcactttgggaggctgaggtgggcggatcgcttgagccaaggagttcgagaccagcctgggcaacattacgagaccctgtctctacaaaaatacaaaaattacccgggcttggtggctcgtgcctatagtcccagctactggggaggctgaggtgggagaatcatctgagcccagggaggttgagactgcagtgagccaagattgtgccactgcactccagcctgggtaaaatgagtgagaccacgtctcaacccctttcacagcccgtctgcggcccacccacccatgggtactgtgggatgggggacaggctggcttaacacaaatcgaggcaggaataaccccagagaatgggctttgcatggagcttggctcctgtccctgcctgtgagggaggaccagactcggcctcaccacctgccactctgagcaaacaggcaacggtgtttcctgaacatctttctgaagcggctgagggatgtcagctgagcccccgctgggcctgctctggagcgggatgtctccagaagccgcccttggagcgggcacttccctatttgggcgtgtcccagtcccatgcctcaccatccccttgcttgaagctccaagagcatgagagtgggcagcctggtctgctgaggaaagtgtctgatggatgcggaaatggccaccccaaacaccggtaagcagatgttaccctgcaggcggtggctcctggggcccagccctgcagaaacacatggggcaggctgggcagaggggctcacacccgttattcccagcgctttgggaggctgaggcgggaggatcgcttgagcccaggagtttgagaccagcctgggcaacatagcaagactctatctccactaaaaatcaaaacaaaacaattagctgggtatggtggcacacgcctgtagttccagctactggggaggctgagggggaggatcacttgagcccaggagttcaaggctgcagtgagccatgattgcgccactgcactccagcctgggcaacagagcaagaccctgccccgccgcctgaaagaaagaaaaaagaaagagaaaggaagagaaagaaaggaaaagaaaaaggaaacatacgaggctatggggccgtgtacgggggccaggctgtggcagaagcatcctggcgtggccttctccagccccatcctggttgggtaaggtgtcgccgtgggtcttcgtgtcacagcttcaaggacagacccaactctggtatcacaaacttaacaggtaatggagtttcctaaagtgtgctctgcaggagtgctggaagggccagcatggaaggaccccagggagggagatttctttgctccacagcatccccaagcctcacgaggcctctcccctccaagtctctatgtgcatcgttctccagatgttggagcatcctgcaggggccagcccagcctgtcaggggcagagaccctgcactggccccctcgagagtggacccctgggctggcttatctgctccagtgcagtgaggatcagctggagctccgacctgactcacatctggatgcgcagtgaggggcccgttggggccgtgatactgggaggaagccgggctctgtgctcttgctccaagtgagttgaccagggagccgaagttaaggtggcctgggagccacgtcctcccacctagcggctgggctctcacagccactagaaacccatcagcctttcccctgggtctatgcggggctcttcagccctcctgggagctcagtggctgggatgctgctttacagacagtgcacggctctgccatctgacagctcccagagggttctgggggtgactgtaaagagtggtgctggccccgaacctttcctgttcccctggatttagttcccagcaggtggtgaggaactgaacattttgtcccatagtggtgggagagagggctggccacatgggtccaggccaccccctcagcctccacagcctgccccgcacccagccacaggaacagcagagcagctcccccatccaggtaagcgcccccaccacagccccatcacaaaggaatagcctcctggtgtagtgggaggtgaggagctttttttgttttccttttatttattttagggacagggtcttgctctgttgccaagttaagtgcagtggtatgatcatgagctcactgcagccttgacatggtggtaaagccatcctcccgcctcagcctttcgagtagctgggactacaggtgtgtgccaccatgcccagacgcccagctaatgtttgtattttttgtagagatgggggtctcactatgttgcccaggctggcctcaagcaatcctcccacctgagccccgcaaagtactcggattacaggtgtgagtcaccgcgcctggccgggagctttaatttttcctacttgttaacagcgttatggggctggaaggaggctctcagatttccctgccctcctcacatcccccaaccctccctgggcgtgggggtgtcaagcatgagtcaggctgagcctgactctgaagctgttcccagctctttagtctaaacttcaaatcttcaaccctgttccctaatccaacacattccccaaatgaagggactggacagtgagatatcgggaaaccccatgaaaatagatgcataataaaggtgaaaatcattt

SEQ ID NO: 162683 - DNA, 2528 bp, Homo sapiens
  Payload ID: 12057
  Gene Symbol: ORAI2
  Gene Name: ORAI calcium release-activated calcium modulator 2
  Uniprot ID: Q96SN7
  ENST ID: ENST00000403646
  CDS Start-End: 100-864
gcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctc

SEQ ID NO: 162684 - DNA, 736 bp, Homo sapiens
  Payload ID: 12057
  Gene Symbol: ORAI2
  Gene Name: ORAI calcium release-activated calcium modulator 2
  ENST ID: ENST00000468241
  CDS Start-End: 100-736
gcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtgg

SEQ ID NO: 162685 - DNA, 2493 bp, Homo sapiens
  Payload ID: 12057
  Gene Symbol: ORAI2
  Gene Name: ORAI calcium release-activated calcium modulator 2
  Uniprot ID: Q96SN7
  ENST ID: ENST00000473939
  CDS Start-End: 49-813
ggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctcaaaaaaaaaaaaaaaa

SEQ ID NO: 162686 - DNA, 5531 bp, Homo sapiens
  Payload ID: 12057
  Gene Symbol: ORAI2
  Gene Name: ORAI calcium release-activated calcium modulator 2
  Uniprot ID: Q96SN7
  ENST ID: ENST00000478730
  CDS Start-End: 210-974
cgctcggcgccccggccgggccactgggccacaggccacgcggccacgcagtccgagcgggagccgagccgggcggggcgagggcagctccggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggggttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcaagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcctggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgcta

SEQ ID NO: 162687 - DNA, 479 bp, Homo sapiens
  Payload ID: 12057
  Gene Symbol: ORAI2
  Gene Name: ORAI calcium release-activated calcium modulator 2
  ENST ID: ENST00000498661
  CDS Start-End: 188-479
tacagcattttctattatgtggagctaacctacggattgcagcgtttctctgaattctccccaagggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttca

SEQ ID NO: 162688 - DNA, 463 bp, Homo sapiens
  Payload ID: 12057
  Gene Symbol: ORAI2
  Gene Name: ORAI calcium release-activated calcium modulator 2
  ENST ID: ENST00000482237
  CDS Start-End: 373-463
aatgctgggcaccccccgaggctcaccctgccaagcctggggctccccttttgcgcccggacccaggggcagggaaagcccagctcgtggtctgtgggtagccggacccccgatggggcggtggggggcctcgccttgactcccagagctggggccggggacaggagctggggcaggagggatgcgcgcgggtcggggtcttcccacctcccctgctcctctccctcgcgcgatcccggggtggttccagggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtcc

SEQ ID NO: 162689 - DNA, 937 bp, Homo sapiens
  Payload ID: 12057
  Gene Symbol: ORAI2
  Gene Name: ORAI calcium release-activated calcium modulator 2
  ENST ID: ENST00000495936
  CDS Start-End: 250-937
accccgcgcgaccggcggaaggagggagggggccgcgctcggcgccccggccgggccactgggccacaggccacgcggccacgcagtccgagcgggagccgagccgggcggggcgagggcagctccgggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgcc

SEQ ID NO: 162690 - DNA, 10679 bp, Homo sapiens
  Payload ID: 12057
  Gene Symbol: ORAI2
  Gene Name: ORAI calcium release-activated calcium modulator 2
  Uniprot ID: Q96SN7
  ENST ID: ENST00000611770
  CDS Start-End: 146-910
gggggaccccgcgcgaccggcggaaggagggagggggccgcgctcggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggggttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcaagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcctggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctattcaaagtctttctgttcttgggggatgctgtgggcagaggggataaattgcagcccctggccctcccgtggcatctgctgactgggggacccacatcgtggcctgaaaaactcctggagcgccctctggcctcctgtcgctggtcactggccagtgtcctcccaggctgccccggcaagggggcgtggacatctctagaatggaggcagggtactcatgtccagacacgccgccatggggctccgccccgagagcgcagggtgcctctgcctggcgcttcccctcccagacagggccctctctttccagaaacaaaagaaggggcagccccagagggtggctgagcgacaacagagcccacctggacagggtcagcttggcgttccccccagtcccttgaggagaggagctaccagagcactggtcacctcaggacattctccagccccaagtccctgtggggcagcaggaacaggtgggtccctcctgcgggctggtggcactgctaaggaagcaccagacagccttttttttttttttgagacagagtcgctctgtcacccaagctggaatgcggtggcatgatcttggctcactgcaacctcctcctcccaggttcaagcgatcttgtgcctcagcctcccaagtagctgggattacaggcacgcaccaccatgcttggctaatttttgtatttttagtagagacgggggtttcaccatgttggccaggctggtctccaactcatgacctcgtgatctgcccacctcggcctcccaaagtgctgggattacaggtgtgagccagcttgcccagcttatgtttatagatttattttagagacagggttgggctctattgcccaggccagagctggagtgcagtggtgcaatcatagctctctgcaggctccagcttctgggcgcaagcaatcctcccacctcagtctcccaagtagctacacttgggagactacgggcgcacactaccatgcccagctaatgttttttttgtagagatgggatcttgctatgttgcccagtctggtcttgaacttctggcctcaagcgaccctcctgccttggcctcccaaagtgctgggattacaggtgcgagccaccatgcctggcccattctgttttttgtcggccactgaggtagaggccctcttctaggaaagaatttctgtttgttttgttttgttttgttttgtttttttgaaacagtctctctctgtctcccaggctggagtgcagtggcgtgatctcagctcgctgcaacctccacttcccaggttcaagcaattcttctgccaagctgggactacaggcatgcaccaccaccatgccctgctaatttttgttgttgtcgttggtttttgagatagagtttcgctcttgttgcccaggctggagtgcagtggcacgatctcagctcaccgcaacctccgcctcccaggttcaagcaattatcttgcctcagcctcccaagtagctgggattacaggcatgcgccaccacacctggcttatttttgtatttttagtagagatggggtttctccatgttagccaagctggtctcgaactcccgacctcagatgatccgcctgcctcagcctcccaaagtgctggggttacaggtgtgagccaccacacccagcctttctttttgcatttttaatagagactgagtttcatcacactggccaggctggtttcgaactcctggcctcaagtgatccgctggcctcagcctcctaaagtgctggattacaggcatgagccaccgtgccaggccttgttaatatttttaactctggcacttcaccctagaggctgctaggaatcaggtgtgccaagcaactggcaccactccatggaaagcgtctagggcagtgccttggttctgccaatcctgagaagccaggctgccccttgggctgggcagtggcctcagtaccgagccccaggccagcaagcccacaagcctcgagaaagactgcacttccggtggaggctgcagtttccttaaagggaaaatctgccccacccctgtcaagggcaggacacaagtcactggcattgaaggacccactccacacccagcagatcatcgacgcagactttttttttcccagatagagtctcactctgtcgtccaggctggactgcaatggtgtgatcttggctcactgtaacctccgcctcccgggctcaagtgattctcctgcctcagcctcctgagtagctaggattacaggcgcccaccatcacgcctggctaatttttgtatttttagtagagacggggttttgccatgttggccaggctggtcttgaactcctgacctcaagtgatcctcctgcctcagcctcccaaagtgctgggattataggcgtgagccacctcgtccggcccaagactttttgcctcagatgctgcagagccctggtggggcccaggagggcaaggcccacacaggagccgaaacccatgtagaacctgccaacctgtagctcacacctataatcccagcactttgggaggctgaggtgggcggatcgcttgagccaaggagttcgagaccagcctgggcaacattacgagaccctgtctctacaaaaatacaaaaattacccgggcttggtggctcgtgcctatagtcccagctactggggaggctgaggtgggagaatcatctgagcccagggaggttgagactgcagtgagccaagattgtgccactgcactccagcctgggtaaaatgagtgagaccacgtctcaacccctttcacagcccgtctgcggcccacccacccatgggtactgtgggatgggggacaggctggcttaacacaaatcgaggcaggaataaccccagagaatgggctttgcatggagcttggctcctgtccctgcctgtgagggaggaccagactcggcctcaccacctgccactctgagcaaacaggcaacggtgtttcctgaacatctttctgaagcggctgagggatgtcagctgagcccccgctgggcctgctctggagcgggatgtctccagaagccgcccttggagcgggcacttccctatttgggcgtgtcccagtcccatgcctcaccatccccttgcttgaagctccaagagcatgagagtgggcagcctggtctgctgaggaaagtgtctgatggatgcggaaatggccaccccaaacaccggtaagcagatgttaccctgcaggcggtggctcctggggcccagccctgcagaaacacatggggcaggctgggcagaggggctcacacccgttattcccagcgctttgggaggctgaggcgggaggatcgcttgagcccaggagtttgagaccagcctgggcaacatagcaagactctatctccactaaaaatcaaaacaaaacaattagctgggtatggtggcacacgcctgtagttccagctactggggaggctgagggggaggatcacttgagcccaggagttcaaggctgcagtgagccatgattgcgccactgcactccagcctgggcaacagagcaagaccctgccccgccgcctgaaagaaagaaaaaagaaagagaaaggaagagaaagaaaggaaaagaaaaaggaaacatacgaggctatggggccgtgtacgggggccaggctgtggcagaagcatcctggcgtggccttctccagccccatcctggttgggtaaggtgtcgccgtgggtcttcgtgtcacagcttcaaggacagacccaactctggtatcacaaacttaacaggtaatggagtttcctaaagtgtgctctgcaggagtgctggaagggccagcatggaaggaccccagggagggagatttctttgctccacagcatccccaagcctcacgaggcctctcccctccaagtctctatgtgcatcgttctccagatgttggagcatcctgcaggggccagcccagcctgtcaggggcagagaccctgcactggccccctcgagagtggacccctgggctggcttatctgctccagtgcagtgaggatcagctggagctccgacctgactcacatctggatgcgcagtgaggggcccgttggggccgtgatactgggaggaagccgggctctgtgctcttgctccaagtgagttgaccagggagccgaagttaaggtggcctgggagccacgtcctcccacctagcggctgggctctcacagccactagaaacccatcagcctttcccctgggtctatgcggggctcttcagccctcctgggagctcagtggctgggatgctgctttacagacagtgcacggctctgccatctgacagctcccagagggttctgggggtgactgtaaagagtggtgctggccccgaacctttcctgttcccctggatttagttcccagcaggtggtgaggaactgaacattttgtcccatagtggtgggagagagggctggccacatgggtccaggccaccccctcagcctccacagcctgccccgcacccagccacaggaacagcagagcagctcccccatccaggtaagcgcccccaccacagccccatcacaaaggaatagcctcctggtgtagtgggaggtgaggagctttttttgttttccttttatttattttagggacagggtcttgctctgttgccaagttaagtgcagtggtatgatcatgagctcactgcagccttgacatggtggtaaagccatcctcccgcctcagcctttcgagtagctgggactacaggtgtgtgccaccatgcccagacgcccagctaatgtttgtattttttgtagagatgggggtctcactatgttgcccaggctggcctcaagcaatcctcccacctgagccccgcaaagtactcggattacaggtgtgagtcaccgcgcctggccgggagctttaatttttcctacttgttaacagcgttatggggctggaaggaggctctcagatttccctgccctcctcacatcccccaaccctccctgggcgtgggggtgtcaagcatgagtcaggctgagcctgactctgaagctgttcccagctctttagtctaaacttcaaatcttcaaccctgttccctaatccaacacattccccaaatgaagggactggacagtgagatatcgggaaaccccatgaaaatagatgcataataaaggtgaaaatcattt

SEQ ID NO: 162691 - DNA, 2206 bp, Homo sapiens
  Payload ID: 12058
  Gene Symbol: ORAI3
  Gene Name: ORAI calcium release-activated calcium modulator 3
  Uniprot ID: Q9BRQ5
  ENST ID: ENST00000318663
  CDS Start-End: 225-1112
ccagttcctgttttggcctccgctgtcccgctccggctcctggggctccccgcagacgctgcttttcttgctccactgggggtgcctcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaagctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaatttttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacaga

SEQ ID NO: 162692 - DNA, 628 bp, Homo sapiens
  Payload ID: 12058
  Gene Symbol: ORAI3
  Gene Name: ORAI calcium release-activated calcium modulator 3
  ENST ID: ENST00000562699
  CDS Start-End: 139-372
tcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatgagataaggaaacaggcccaagaaggctgaagatcttgcccaaaaccacacagctagtccatgaaactgaacttggactatctacccctcacacgggaatctctctttgatttgagaaaaggaaccagtgcctttcaactggaacagaaaggaatctgatctcaacacctatgcctccacgtaaattatttttttcagccttatttccctcaaaattgtagagtcctaatcttcttctatcttgtggtgtgagaccttggata

SEQ ID NO: 162693 - DNA, 976 bp, Homo sapiens
  Payload ID: 12058
  Gene Symbol: ORAI3
  Gene Name: ORAI calcium release-activated calcium modulator 3
  ENST ID: ENST00000563161
  CDS Start-End: 210-506
gcctccgctgtcccgctccggctcctggggctccccgcagacgctgcttttcttgctccactgggggtgcctcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggggaccccaggagacggggccaccggaggacacgaaagtcctaaaggtgtcgtagtgggagtggggtgaacaaatcgctggtggggttgactgcaacagtgaggcagagtggtccagatggagcctgtacctggcagaagtggttcctaagtcccagtgccagcttcaaaggcaggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctgg

SEQ ID NO: 162694 - DNA, 1393 bp, Homo sapiens
  Payload ID: 12058
  Gene Symbol: ORAI3
  Gene Name: ORAI calcium release-activated calcium modulator 3
  ENST ID: ENST00000566237
  CDS Start-End: 168-1010
gctgcttttcttgctccactgggggtgcctcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaagctgagccagcctgcccaccccggcaagcctgtggtggtggtggggcccatgggccaggctggcaagcagccatggcctccacagccatcatgggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaatttttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgta

SEQ ID NO: 162695 - DNA, 2478 bp, Homo sapiens
  Payload ID: 12059
  Gene Symbol: ORAOV1
  Gene Name: oral cancer overexpressed 1
  Uniprot ID: Q8WV07
  ENST ID: ENST00000279147
  CDS Start-End: 109-522
gggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctcgccacacatgccctttgttgggctgaagccgtccctggcagagccctcgtgcattgacttgacagcctctccggcagcacaggcctagctggttctgggttggagttggctctggatagggtcagtcaccaggcctggactgaaggcagttatttttattattattattatttgcaatgagagagatggttggccccgaatgaggctcatgggaggtttggacgggtgctgtgccgcatgtcgaggccgattgtgtgccaggcggtgcgggacgtgcctcccgtgtgttatttaatcccttcaggagcccacaagatgggtgttattctcattttacagaggagggaggggagacgcgaagggattgcctggtctaagggcacccagcagcagagctaggacttccgccctaaggctgtgcctcactgccaccaggcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctcttttgtctctgtccttacgaggcgtcatacagaggcagtggggtgggcacagatgagcagagtggatggttcggtgggtccccacgaggcgagtggtggtcatatgtgatggcacgtgttcacacaccctcctgtgtacccccccagggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaa

SEQ ID NO: 162696 - DNA, 359 bp, Homo sapiens
  Payload ID: 12059
  Gene Symbol: ORAOV1
  Gene Name: oral cancer overexpressed 1
  ENST ID: ENST00000441922
  CDS Start-End: 9-221
ttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatg

SEQ ID NO: 162697 - DNA, 775 bp, Homo sapiens
  Payload ID: 12059
  Gene Symbol: ORAOV1
  Gene Name: oral cancer overexpressed 1
  ENST ID: ENST00000542341
  CDS Start-End: 178-408
acaggctgctttgggccctcccgcgtgccgttcttacccggcctgccccgcgccgccgcttccggaagtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacaggtaaaggtggagatgtctttctttctcagcgtaggaaccaggagttctagttccatgggttaccagcatgcccttgagtaatcaatctgtctgttcctcatctgtaaaatggagaaaattatcagtgtcaagcttgagtgttgttaggagatttaacggaaatactaaatagaaagtgccaggcacattttaggtgtttggtgaacactggctgttgttgcttctcaagagttctatgctcctgccttttacctggagtcattagtgcaccatgtggcttttagataccctaccaataaaataatgttgacattgattgtattttctcattcacctttcccctgagcttctaataaacaaattataacagt

SEQ ID NO: 162698 - DNA, 2274 bp, Homo sapiens
  Payload ID: 12059
  Gene Symbol: ORAOV1
  Gene Name: oral cancer overexpressed 1
  ENST ID: ENST00000536870
  CDS Start-End: 85-321
gcatttgtgcctgaagctgccgggtctgctacggcaccgcggggctgcagaaacccgggggccaagggcgggctgcttgccgctatggctggcagtcaggacatattcgatgccatcgtgatggcggatgagagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctcgccacacatgccctttgttgggctgaagccgtccctggcagagccctcgtgcattgacttgacagcctctccggcagcacaggcctagctggttctgggttggagttggctctggatagggtcagtcaccaggcctggactgaaggcagttatttttattattattattatttgcaatgagagagatggttggccccgaatgaggctcatgggaggtttggacgggtgctgtgccgcatgtcgaggccgattgtgtgccaggcggtgcgggacgtgcctcccgtgtgttatttaatcccttcaggagcccacaagatgggtgttattctcattttacagaggagggaggggagacgcgaagggattgcctggtctaagggcacccagcagcagagctaggacttccgccctaaggctgtgcctcactgccaccaggcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctcttttgtctctgtccttacgaggcgtcatacagaggcagtggggtgggcacagatgagcagagtggatggttcggtgggtccccacgaggcgagtggtggtcatatgtgatggcacgtgttcacacaccctcctgtgtacccccccagggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtg

SEQ ID NO: 162699 - DNA, 951 bp, Homo sapiens
  Payload ID: 12059
  Gene Symbol: ORAOV1
  Gene Name: oral cancer overexpressed 1
  ENST ID: ENST00000535542
  CDS Start-End: 67-177
gccgggtctgctacggcaccgcggggctgcagaaacccgggggccaagggcgggctgcttgccgctatggctggcagtcaggacatattcgatgccatcgtgatggcggatgagagagcccctggggagcccctcgtgctgcgacagtgggggagctgtgagttgcctcctggctgacttccagtgcccggcccagaggacgcgtccatagatgttagttaagaaagcggccgaacatttagcagtcaggcgctgacgtttatttagctcgcgctgtgagtcagacactgagctaaacgttccaccctggttatctacttcagccctacttagtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctcgccacacatgccctttgttgggctgaagccgtccctggcagagccctcgtgcattgactt

SEQ ID NO: 162700 - DNA, 444 bp, Homo sapiens
  Payload ID: 12059
  Gene Symbol: ORAOV1
  Gene Name: oral cancer overexpressed 1
  ENST ID: ENST00000543562
  CDS Start-End: 112-243
agtgggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaa

SEQ ID NO: 162701 - DNA, 817 bp, Homo sapiens
  Payload ID: 12059
  Gene Symbol: ORAOV1
  Gene Name: oral cancer overexpressed 1
  ENST ID: ENST00000539414
  CDS Start-End: 84-458
catttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacaggtgcgtgcactgtgtgtttcctcctgctaggagcacctgattgcgcctttcccaggcggggcagcgcactcccggggccgctgcggcaatggcctggggctgcgtgcgccgcggaactgtccgtagaggcgcctcatccttgagtcgcagtgcaggaaaactgaagacagtccagagaaaaggagttagaactcatttatgggctggccacatagacaggaaaagctatagctagagatagagttatcttctcatttttcagtaaaaatgcacaagattaaaaataccatctcttttgtgttttcagttttgttcgttactcaatgttcagccagactttaaaattagtgcagaaggttccggactttcattttgaggaggatggatga

SEQ ID NO: 162702 - DNA, 709 bp, Homo sapiens
  Payload ID: 12059
  Gene Symbol: ORAOV1
  Gene Name: oral cancer overexpressed 1
  Uniprot ID: Q8WV07
  ENST ID: ENST00000535657
  CDS Start-End: 83-496
atttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaa

SEQ ID NO: 162703 - DNA, 1000 bp, Homo sapiens
  Payload ID: 12059
  Gene Symbol: ORAOV1
  Gene Name: oral cancer overexpressed 1
  ENST ID: ENST00000538554
  CDS Start-End: 106-771
tctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagacgggcctttcgccttccgccgtgatggtgaggcctcccagctacgtagaactgccggttacatgttggtgctgggaagcgccgcggtgcaaccagaaatgcacagacccagccgcccgccgcccagaccctcagacttgcgcgtcacaggacagactccgctgtgccccgtgcacttgccaccagcctttggcctctcgatacacacaacatccaggacttgtgcccttgccccatcacgacagacaaagcgtccctcaaggcccccgcgtggttcagacagacgccgcagccaggatggttgagcagcaaacaatgtgaaagagatacacagaagcgatgtgaatatttccaaaccgtgcctggaagtcaacggtagcagcgcaataagaaaatggagctgcggcctgtccccggtgtgggcaccgccccttcccctcgggagcctcctcctcacacctcctcccgcctgtcctccctcacacgtcagcctccacactcttgccacctcccttcaacacttcctaaataaaaattacaagaattacat

SEQ ID NO: 162704 - DNA, 988 bp, Homo sapiens
  Payload ID: 12059
  Gene Symbol: ORAOV1
  Gene Name: oral cancer overexpressed 1
  ENST ID: ENST00000537272
  CDS Start-End: 1-187
cagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtgg

SEQ ID NO: 162705 - DNA, 3611 bp, Homo sapiens
  Payload ID: 12060
  Gene Symbol: OFD1
  Gene Name: oral-facial-digital syndrome 1
  Uniprot ID: O75665
  ENST ID: ENST00000340096
  CDS Start-End: 328-3366
cggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaagtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaa

SEQ ID NO: 162706 - DNA, 3296 bp, Homo sapiens
  Payload ID: 12060
  Gene Symbol: OFD1
  Gene Name: oral-facial-digital syndrome 1
  Uniprot ID: O75665
  ENST ID: ENST00000380550
  CDS Start-End: 175-3093
gggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtca

SEQ ID NO: 162707 - DNA, 3736 bp, Homo sapiens
  Payload ID: 12060
  Gene Symbol: OFD1
  Gene Name: oral-facial-digital syndrome 1
  ENST ID: ENST00000380567
  CDS Start-End: 873-3491
cggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaagccattaagtctgtgacttaatcgccaagtctcttggtagtaatgttagcagaatataaataaattggagcacaagatattctggactgcccgcaaactagaccatctctactgaagttcagtatggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaagtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaa

SEQ ID NO: 162708 - DNA, 3307 bp, Homo sapiens
  Payload ID: 12060
  Gene Symbol: OFD1
  Gene Name: oral-facial-digital syndrome 1
  ENST ID: ENST00000398395
  CDS Start-End: 709-1725
gggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaagccattaagtctgtgacttaatcgccaagtctcttggtagtaatgttagcagaatataaataaattggagcacaagatattctggactgcccgcaaactagaccatctctactgaagttcagtatggttttcttatgcatttttaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtca

SEQ ID NO: 162709 - DNA, 1455 bp, Homo sapiens
  Payload ID: 12061
  Gene Symbol: OSCP1
  Gene Name: organic solute carrier partner 1
  Uniprot ID: Q8WVF1
  ENST ID: ENST00000235532
  CDS Start-End: 83-1222
attgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttga

SEQ ID NO: 162710 - DNA, 767 bp, Homo sapiens
  Payload ID: 12061
  Gene Symbol: OSCP1
  Gene Name: organic solute carrier partner 1
  Uniprot ID: Q8WVF1
  ENST ID: ENST00000354267
  CDS Start-End: 75-746
gctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgaagagagtgcttctggaagcatatgcaagaaactgttcacagtgcacagtgttgccttccaggagtggggaactatatggaggacaggagaaggagactgactttccattatgtatacccttttgagaactttgagttttgtacctgggcaaaataaaattttaaaaaggggaagaaa

SEQ ID NO: 162711 - DNA, 1463 bp, Homo sapiens
  Payload ID: 12061
  Gene Symbol: OSCP1
  Gene Name: organic solute carrier partner 1
  Uniprot ID: Q8WVF1
  ENST ID: ENST00000356637
  CDS Start-End: 65-1234
ggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagatgaatggacagaggtggacagaaaacgagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaac

SEQ ID NO: 162712 - DNA, 1381 bp, Homo sapiens
  Payload ID: 12061
  Gene Symbol: OSCP1
  Gene Name: organic solute carrier partner 1
  ENST ID: ENST00000433045
  CDS Start-End: 181-1185
taagctatttccctagctcctaataagggctcaaagaccccagagaaatgactcagcacctaggtgaatagcagccctttgtaagcattaacctaaccagagttgatgtgatgcttcaacttgaattcttctttggcactcctcctccctggcttacttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacaca

SEQ ID NO: 162713 - DNA, 989 bp, Homo sapiens
  Payload ID: 12061
  Gene Symbol: OSCP1
  Gene Name: organic solute carrier partner 1
  ENST ID: ENST00000445843
  CDS Start-End: 1-768
ccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccagacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaa

SEQ ID NO: 162714 - DNA, 505 bp, Homo sapiens
  Payload ID: 12061
  Gene Symbol: OSCP1
  Gene Name: organic solute carrier partner 1
  ENST ID: ENST00000468441
  CDS Start-End: 1-284
gatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccagtctcttttcagcaatctggccaccattcaggggggcctgactgggtgacagatgaatgggaaggttctgacctgttttgagtccggctcccaccttgctgtcacatatcagaatgtcactgctctgagtgtgtcccagggccttggaggtgggccgtgaggtgccgagaagcagccgcagcctcctccctccacctatcccagagcgatgctggtgatttcaaacgtatctgtcctatcagtaaataaacaagatgcagatctctggta

SEQ ID NO: 162715 - DNA, 281 bp, Homo sapiens
  Payload ID: 12061
  Gene Symbol: OSCP1
  Gene Name: organic solute carrier partner 1
  ENST ID: ENST00000524789
  CDS Start-End: 1-41
agaacatcccgggagacaaggcccgcaaagattttgactgagtgtcaaacactatgtgagatactatatggagcctgatgcagcccttctggacattcactggagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatg
